United States Patent
Verweij et al.

(10) Patent No.: US 11,773,393 B2
(45) Date of Patent: *Oct. 3, 2023

(54) TREATMENT OF LIVER DISEASES WITH CELL DEATH INDUCING DFFA LIKE EFFECTOR B (CIDEB) INHIBITORS

(71) Applicant: Regeneron Pharmaceuticals, Inc., Tarrytown, NY (US)

(72) Inventors: Niek Verweij, Tarrytown, NY (US); Luca Andrea Lotta, Tarrytown, NY (US); Aris Baras, Tarrytown, NY (US); Mary Haas, Tarrytown, NY (US); Jonas Nielsen, Tarrytown, NY (US); Olukayode Sosina, Tarrytown, NY (US); Adam Locke, Tarrytown, NY (US)

(73) Assignee: Regeneron Pharmaceuticals, Inc., Tarrytown, NY (US)

( * ) Notice: Subject to any disclaimer, the term of this patent is extended or adjusted under 35 U.S.C. 154(b) by 0 days.

This patent is subject to a terminal disclaimer.

(21) Appl. No.: 17/709,705

(22) Filed: Mar. 31, 2022

(65) Prior Publication Data

US 2022/0282253 A1 Sep. 8, 2022

Related U.S. Application Data

(63) Continuation of application No. 17/560,008, filed on Dec. 22, 2021.

(60) Provisional application No. 63/257,137, filed on Oct. 19, 2021, provisional application No. 63/246,101, filed on Sep. 20, 2021, provisional application No. 63/149,258, filed on Feb. 13, 2021, provisional application No. 63/129,725, filed on Dec. 23, 2020.

(51) Int. Cl.

| | |
|---|---|
| *C12N 15/113* | (2010.01) |
| *A61P 1/16* | (2006.01) |
| *A61K 31/7088* | (2006.01) |
| *A61K 38/46* | (2006.01) |
| *C12Q 1/6883* | (2018.01) |

(52) U.S. Cl.
CPC ........ *C12N 15/113* (2013.01); *A61K 31/7088* (2013.01); *A61K 38/465* (2013.01); *A61P 1/16* (2018.01); *C12N 15/1137* (2013.01); *C12Q 1/6883* (2013.01); *C12N 2310/122* (2013.01); *C12N 2310/14* (2013.01); *C12N 2310/531* (2013.01); *C12N 2320/31* (2013.01); *C12Q 2600/106* (2013.01); *C12Q 2600/158* (2013.01)

(58) Field of Classification Search
CPC ............. C12N 15/113; C12N 15/1137; C12N 2310/14; C12N 2320/31; C12N 2320/34; C12Q 2600/156; C12Q 2600/158

USPC ............... 435/6.1, 91.1, 91.31, 455, 458; 514/44 A, 44 R; 536/23.1, 24.5
See application file for complete search history.

(56) References Cited

U.S. PATENT DOCUMENTS

| | | |
|---|---|---|
| 7,341,749 B2 | 3/2008 | Hall et al. |
| 8,445,207 B2 | 5/2013 | Ryu et al. |
| 9,205,064 B2 | 12/2015 | Narain et al. |
| 9,896,731 B2 | 2/2018 | Narain et al. |
| 10,351,915 B2 | 7/2019 | Narain et al. |
| 10,519,504 B2 | 12/2019 | Narain et al. |
| 10,980,932 B2 | 4/2021 | Le et al. |
| 11,021,545 B2 | 6/2021 | Kwon et al. |
| 11,028,446 B2 | 6/2021 | Narain et al. |
| 11,078,247 B2 | 8/2021 | Fotin-Mleczek et al. |
| 2009/0215853 A1 | 8/2009 | Hall et al. |
| 2010/0173024 A1 | 7/2010 | McDaniel |
| 2010/0226980 A1 | 9/2010 | Moreau |
| 2011/0020312 A1 | 1/2011 | Narain et al. |
| 2011/0027247 A1 | 2/2011 | Narain et al. |
| 2011/0064739 A1 | 3/2011 | Borlak et al. |
| 2011/0123986 A1 | 5/2011 | Narain et al. |
| 2012/0015839 A1 | 1/2012 | Chinnaiyan |
| 2013/0203615 A1 | 8/2013 | Groskopf et al. |
| 2013/0252845 A1 | 9/2013 | Son et al. |
| 2014/0079836 A1 | 3/2014 | McDaniel |
| 2014/0342946 A1 | 11/2014 | Kuriakose et al. |
| 2015/0337390 A1 | 11/2015 | Groskopf et al. |
| 2016/0145693 A1 | 5/2016 | Narain et al. |
| 2017/0137879 A1 | 5/2017 | Narain et al. |
| 2018/0334721 A1 | 11/2018 | Narain et al. |
| 2019/0010554 A1 | 1/2019 | Narain et al. |
| 2019/0071795 A1 | 3/2019 | Nerenberg et al. |
| 2020/0010880 A1 | 1/2020 | Ku et al. |
| 2021/0002725 A1 | 1/2021 | Narain et al. |
| 2021/0047752 A1 | 2/2021 | Nerenberg et al. |
| 2021/0002296 A1 | 7/2021 | Mainolfi et al. |

FOREIGN PATENT DOCUMENTS

| | | | |
|---|---|---|---|
| WO | 2012149386 | 11/2012 | |
| WO | WO-2012149386 A1 * | 11/2012 | ............. C07H 21/04 |
| WO | 2013022872 | 2/2013 | |
| WO | 2014089121 | 6/2014 | |
| WO | 2016130806 | 8/2016 | |
| WO | WO-2016130806 A2 * | 8/2016 | ......... A61K 31/7125 |
| WO | 2017067477 | 4/2017 | |
| WO | 2019075181 | 4/2019 | |
| WO | WO-2019075181 A1 * | 4/2019 | ........... A61K 31/713 |

OTHER PUBLICATIONS

Abul-Husn et al (N. Engl. J. Med., vol. 378, No. 12, pp. 1096-1106 (2018)) (Year: 2018).*
U.S. Appl. No. 17/560,008.*
Li et al., "Cideb Regulates Diet-Induced Obesity, Liver Steatosis, and Insulin Sensitivity by Controlling Lipogenesis and Fatty Acid Oxidation", Diabetes, 2007, 56(10), pp. 2523-2532.
(Continued)

*Primary Examiner* — Jane J Zara
(74) *Attorney, Agent, or Firm* — Armstrong Teasdale LLP

(57) ABSTRACT

The present disclosure provides methods of treating subjects having a liver disease, and methods of identifying subjects having an increased risk of developing liver disease.

27 Claims, 19 Drawing Sheets
(18 of 19 Drawing Sheet(s) Filed in Color)
Specification includes a Sequence Listing.

(56) References Cited

OTHER PUBLICATIONS

Dong et al., "PNPLA3 Potential Therapeutic Target for Personalized Treatment of Chronic Liver Disease", Frontiers in Medicine, 2019, 6, pp. 1-11.
Linden et al., "Pnpla3 silencing with antisense oligonucleotides ameliorates nonalcoholic steatohepatitis and fibrosis in Pnpla3 I148M knock-in mice", Molecular Metabolism, 2019, 22, pp. 49-61.
International Search Report and Written Opinion dated Jun. 10, 2022 for International Patent Application No. PCT/US2021/064987.

* cited by examiner

US 11,773,393 B2

TREATMENT OF LIVER DISEASES WITH CELL DEATH INDUCING DFFA LIKE EFFECTOR B (CIDEB) INHIBITORS

REFERENCE TO A SEQUENCE LISTING

This application includes a Sequence Listing submitted electronically as a text file named 18923806201SEQ, created on Dec. 21, 2021, with a size of 2,576 kilobytes. The Sequence Listing is incorporated herein by reference.

FIELD

The present disclosure relates generally to the treatment of subjects having a liver disease with cell death inducing DFFA like effector B (CIDEB) inhibitors, patatin-like phospholipase domain containing 3 (PNPLA3) inhibitors, or hydroxysteroid 17-beta dehydrogenase 13 (HSD17B13) inhibitors, or any combination thereof, and methods of identifying subjects having an increased risk of developing a liver disease.

BACKGROUND

Chronic liver disease and liver cirrhosis are leading causes of morbidity and mortality in the United States, accounting for 38,170 deaths (1.5% of total deaths) in 2014 (Kochanek et al., Nat'l. Vital Stat. Rep., 2016, 65, 1-122). The most common etiologies of liver cirrhosis in the U.S. are alcoholic liver disease, chronic hepatitis C, and nonalcoholic fatty liver disease (NAFLD), together accounting for about 80% of patients awaiting liver transplant between 2004 and 2013 (Wong et al., Gastroenterology, 2015, 148, 547-555). The estimated prevalence of NAFLD in the U.S. is between 19 and 46 percent (Browning et al., Hepatology, 2004, 40, 1387-1395; Lazo et al., Am. J. Epidemiol., 2013, 178, 38-45; and Williams et al., Gastroenterology, 2011, 140, 124-131) and has been rising over time (Younossi et al., Clin. Gastroenterol. Hepatol., 2011, 9, 524-530), likely in conjunction with increased prevalence of obesity, which is one of its primary risk factors (Cohen et al., Science, 2011, 332, 1519-1523). While significant advances have been made in the treatment of hepatitis C, there are currently no evidence-based treatments for alcoholic or nonalcoholic liver disease or liver cirrhosis. Identifying naturally occurring genetic variants that protect from liver damage and liver disease outcomes can be a pathway to identify novel therapeutic targets for liver disease (Abul-Husn et al. N. Engl. J. Med., 2018, 378, 1096-106).

CIDEB is expressed in the liver and small intestine and has been shown to play roles in regulating various aspects of lipid metabolism. CIDEB may participate in lipid metabolism by regulating lipid droplet fusion and very low density lipoprotein (VLDL) lipidation by interacting with ApoB. CIDEB is also required for the biogenesis of VLDL transport vesicles and for chylomicron lipidation in the small intestine. In addition, CIDEB regulates hepatic SREBP activation (master regulators of lipid metabolism) by selectively promoting ER-to-Golgi delivery of the SREBP/SCAP complex. Sterol depletion induces SCAP to interact with CIDEB, which also binds Sec12, the GEF of Sar1, thereby enriching SCAP/SREBP at ER exit sites and increasing the packaging of SREBP/SCAP into COPII-coated vesicles.

SUMMARY

The present disclosure provides methods of treating a subject having a liver disease or at risk of developing a liver disease, the methods comprising administering a CIDEB inhibitor to the subject.

The present disclosure also provides methods of treating a subject with a CIDEB inhibitor, wherein the subject has a liver disease or is at risk of developing a liver disease, the methods comprising the steps of: determining whether the subject has a CIDEB variant nucleic acid molecule by: obtaining or having obtained a biological sample from the subject; and performing or having performed a sequence analysis on the biological sample to determine if the subject has a genotype comprising the CIDEB variant nucleic acid molecule; and administering or continuing to administer the CIDEB inhibitor in a standard dosage amount to a CIDEB reference subject; and administering or continuing to administer the CIDEB inhibitor in a dosage amount that is the same as or less than a standard dosage amount to a subject that is heterozygous or homozygous for the CIDEB variant nucleic acid molecule; wherein the presence of a genotype having the CIDEB variant nucleic acid molecule indicates the subject has a decreased risk of developing the liver disease or has a decreased risk of developing a more severe form of the liver disease.

The present disclosure also provides methods of identifying a subject having an increased risk of developing a liver disease, the methods comprising: determining or having determined the presence or absence of a CIDEB variant nucleic acid molecule in a biological sample obtained from the subject; wherein: when the subject is CIDEB reference, the subject has an increased risk of developing the liver disease; and when the subject is heterozygous or homozygous for the CIDEB variant nucleic acid molecule, the subject has a decreased risk of developing the liver disease or has a decreased risk of developing a more severe form of the liver disease.

The present disclosure also provides therapeutic compositions that treat or inhibit a liver disease for use in the treatment of a liver disease in a subject having a CIDEB variant nucleic acid molecule comprising: 14:24305635:A: AGTAG, 14:24305641:A:C, 14:24305650:G:A, 14:24305657:C:A, 14:24305662:G:T, 14:24305667:T:C, 14:24305671:C:A, 14:24305671:C:G, 14:24305701:A:T, 14:24305709:C:T, 14:24305718:A:G, 14:24305721:T:C, 14:24305728:G:GGCCTT, 14:24305743:T:C, 14:24305948: T:C, 14:24305966:C:T, 14:24305974:T:C, 14:24305980: TCA:T, 14:24305988:C:T, 14:24306014:C:T, 14:24306034: A:C, 14:24306041:C:G, 14:24306044:G:A, 14:24306047: G:A, 14:24306051:T:G, 14:24306064:T:C, 14:24306074:A: G, 14:24306077:G:C, 14:24306082:A:G, 14:24306083:T:A, 14:24306095:G:A, 14:24306122:A:G, 14:24306134:C:G, 14:24306373:C:G, 14:24306379:T:C, 14:24306382:G:A, 14:24306383:G:T, 14:24306426:T:G, 14:24306437:C:G, 14:24306439:G:C, 14:24306442:A:G, 14:24306444:A:G, 14:24306457:C:T, 14:24306463:C:T, 14:24306469:C:T, 14:24306480:A:G, 14:24306486:A:C, 14:24306504:A:G, 14:24306519:A:G, 14:24307382:G:C, 14:24307405:A:G, 14:24307417:A:T, 14:24307421:T:A, 14:24307441:C:A, 14:24307444:A:C, 14:24307444:A:G, 14:24307450:C: CGCTG, 14:24307461:TG:T, 14:24307469:AG:A, 14:24307474:C:T, 14:24307475:A:G, 14:24307833:G:C, 14:24307851:T:TAC, 14:24306426:T:C, 14:24307849:G:C, 14:24307448:G:T, 14:24305671:C:T, 14:24305663:C:T, 14:24305686:C:G, 14:24307829:A:C, 14:24307818:CT-GAG:C, 14:24307856:C:T, 14:24306423:T:C, 14:24306061:AC:A, 14:24307390:C:T, 14:24306382:G:T, 14:24306373:C:T, 14:24305733:T:C, 14:24307858:T:C, 14:24306387:C:T, 14:24305637:T:C, 14:24306062:C:T, 14:24307853:C:G, 14:24307450:C:G, 14:24306052:TG:T, 14:24305673:G:A, 14:24306043:C:T, 14:24307834:G:A, 14:24306417:C:T, 14:24307451:G:A, 14:24307436:A:C, 14:24305953:ACTTT:A, 14:24306489:G:T, 14:24307441:C:T, 14:24306375:C:T, 14:24305657:C:G, 14:24306427:C:T, 14:24306524:C:T, 14:24307516:C:A, 14:24307840:G:C, 14:24307501:A:G, 14:24305968:A:C, 14:24305986:C:T, 14:24307441:C:G, 14:24307459:G:T, 14:24306017:T:A, 14:24307424:G:A, 14:24306072:G:T, 14:24307423:C:T, 14:24307450:C:T, 14:24306420:G:A, 14:24307454:G:A, 14:24305653:C:T, 14:24307442:G:A, 14:24306002:C:T, 14:24306076:C:T, 14:24305664:C:T, 14:24305961:TG:T, 14:24305706:A:G, 14:24305946:C:T, 14:24306455:G:C, 14:24307468:G:A, 14:24307825:A:C, 14:24306110:G:A, 14:24305710:C:T, 14:24307483:C:T, 14:24306459:A:G, 14:24305754:C:T, 14:24305650:G:C, 14:24305691:C:T, 14:24306508:G:C, 14:24306039:G:T, 14:24306139:T:C, 14:24306391:T:C, 14:24306373:C:A, 14:24307498:C:T, 14:24307415:G:A, 14:24306138:CTG:C, 14:24307453:T:C, 14:24305692:G:A, 14:24305683:C:G, 14:24307484:G:A, 14:24307385:C:T, 14:24306519:A:T, 14:24307839:A:C, 14:24305965:C:T, 14:24305988:CAT:C, 14:24306087:C:G, 14:24307439:C:T, 14:24307477:A:C, 14:24306436:G:T, 14:24306507:A:G, 14:24307397:C:T, 14:24307495:G:A, 14:24306034:A:T, 14:24306013:G:A, 14:24307381:A:G, 14:24306383:G:C, 14:24305638:A:G, 14:24307420:G:A, 14:24306020:C:T, 14:24306470:A:C, 14:24307435:C:T, 14:24306469:C:G, 14:24306451:C:T, 14:24306403:G:A, 14:24307515:C:G, 14:24307489:A:G, 14:24307414:C:T, 14:24306483:A:G, 14:24305755:G:A, 14:24305766:C:T, 14:24306064:T:G, 14:24307516:C:G, 14:24305766:C:G, 14:24306489:G:A, 14:24306097:T:C, 14:24305763:T:G, 14:24307447:G:A, 14:24307402:G:A, 14:24305972:C:G, 14:24306423:T:G, 14:24305974:T:TG, 14:24307411:T:C, 14:24306121:T:C, 14:24307516:C:T, 14:24306424:C:T, 14:24306039:G:C, 14:24307853:C:A, 14:24306388:A:G, 14:24305990:T:C, 14:24307822:G:GT, 14:24305640:G:A, 14:24307418:T:C, 14:24305758:G:C, 14:24306131:C:T, 14:24305953:A:G, 14:24305730:C:A, 14:24306418:A:G, 14:24306059:AC:A, 14:24307842:G:A, 14:24307837:T:G, 14:24306095:G:T, 14:24306109:C:T, 14:24307822:G:A, 14:24306077:G:A, 14:24307824:A:T, 14:24306080:C:T, 14:24305649:C:T, 14:24306433:G:GA, 14:24306420:G:C, 14:24305658:T:G, 14:24306472:C:T, 14:24307412:TC:T, 14:24306062:C:A, 14:24306044:G:C, 14:24306047:G:T, 14:24306126:CAG:C, 14:24306449:C:G, 14:24307391:G:A, or 14:24307857:A:C, according to GRCh38/hg38 human genome assembly coordinates.

The present disclosure also provides compositions comprising a CIDEB inhibitor, a PNPLA3 inhibitor, or an HSD17B13 inhibitor, or any combination thereof, for use in the treatment of a liver disease in a subject having a CIDEB variant nucleic acid molecule comprising: 14:24305635:A:AGTAG, 14:24305641:A:C, 14:24305650:G:A, 14:24305657:C:A, 14:24305662:G:T, 14:24305667:T:C, 14:24305671:C:A, 14:24305671:C:G, 14:24305701:A:T, 14:24305709:C:T, 14:24305718:A:G, 14:24305721:T:C, 14:24305728:G:GGCCTT, 14:24305743:T:C, 14:24305948:T:C, 14:24305966:C:T, 14:24305974:T:C, 14:24305980:TCA:T, 14:24305988:C:T, 14:24306014:C:T, 14:24306034:A:C, 14:24306041:C:G, 14:24306044:G:A, 14:24306047:G:A, 14:24306051:T:G, 14:24306064:T:C, 14:24306074:A:G, 14:24306077:G:C, 14:24306082:A:G, 14:24306083:T:A, 14:24306095:G:A, 14:24306122:A:G, 14:24306134:C:G, 14:24306373:C:G, 14:24306379:T:C, 14:24306382:G:A, 14:24306383:G:T, 14:24306426:T:G, 14:24306437:C:G, 14:24306439:G:C, 14:24306442:A:G, 14:24306444:A:G, 14:24306457:G:A, 14:24306463:C:T, 14:24306469:C:T, 14:24306480:A:G, 14:24306486:A:C, 14:24306504:A:G, 14:24306519:A:G, 14:24307382:G:C, 14:24307405:A:G, 14:24307417:A:T, 14:24307421:T:A, 14:24307441:C:A, 14:24307444:A:C, 14:24307444:A:G, 14:24307450:C:CGCTG, 14:24307461:TG:T, 14:24307469:AG:A, 14:24307474:C:T, 14:24307475:A:G, 14:24307833:G:C, 14:24307851:T:TAC, 14:24306426:T:C, 14:24307849:G:C, 14:24307448:G:T, 14:24305671:C:T, 14:24305663:C:T, 14:24305686:C:G, 14:24307829:A:C, 14:24307818:CTGAG:C, 14:24307856:C:T, 14:24306423:T:C, 14:24306061:AC:A, 14:24307390:C:T, 14:24306382:G:T, 14:24306373:C:T, 14:24305733:T:C, 14:24307858:T:C, 14:24306387:C:T, 14:24305637:T:C, 14:24306062:C:T, 14:24307853:C:G, 14:24307450:C:G, 14:24306052:TG:T, 14:24305673:G:A, 14:24306043:C:T, 14:24307834:G:A, 14:24306417:C:T, 14:24307451:G:A, 14:24307436:A:C, 14:24305953:ACTTT:A, 14:24306489:G:T, 14:24307441:C:T, 14:24306375:C:T, 14:24305657:C:G, 14:24306427:C:T, 14:24306524:C:T, 14:24307516:C:A, 14:24307840:G:C, 14:24307501:A:G, 14:24305968:A:C, 14:24305986:C:T, 14:24307441:C:G, 14:24307459:G:T, 14:24306017:T:A, 14:24307424:G:A, 14:24306072:G:T, 14:24307423:C:T, 14:24307450:C:T, 14:24306420:G:A, 14:24307454:G:A, 14:24305653:C:T, 14:24307442:G:A, 14:24306002:C:T, 14:24306076:C:T, 14:24305664:C:T, 14:24305961:TG:T, 14:24305706:A:G, 14:24305946:C:T, 14:24306455:G:C, 14:24307468:G:A, 14:24307825:A:C, 14:24306110:G:A, 14:24305710:C:T, 14:24307483:C:T, 14:24306459:A:G, 14:24305754:C:T, 14:24305650:G:C, 14:24305691:C:T, 14:24306508:G:C, 14:24306039:G:T, 14:24306139:T:C, 14:24306391:T:C, 14:24306373:C:A, 14:24307498:C:T, 14:24307415:G:A, 14:24306138:CTG:C, 14:24307453:T:C, 14:24305692:G:A, 14:24305683:C:G, 14:24307484:G:A, 14:24307385:C:T, 14:24306519:A:T, 14:24307839:A:C, 14:24305965:C:T, 14:24305988:CAT:C, 14:24306087:C:G, 14:24307439:C:T, 14:24307477:A:C, 14:24306436:G:T, 14:24306507:A:G, 14:24307397:C:T, 14:24307495:G:A, 14:24306034:A:T, 14:24306013:G:A, 14:24307381:A:G, 14:24306383:G:C, 14:24305638:A:G, 14:24307420:G:A, 14:24306020:C:T, 14:24306470:A:C, 14:24307435:C:T, 14:24306469:C:G, 14:24306451:C:T, 14:24306403:G:A, 14:24307515:C:G, 14:24307489:A:G, 14:24307414:C:T, 14:24306483:A:G, 14:24305755:G:A, 14:24305766:C:T, 14:24306064:T:G, 14:24307516:C:G, 14:24305766:C:G, 14:24306489:G:A, 14:24306097:T:C, 14:24305763:T:G, 14:24307447:G:A, 14:24307402:G:A, 14:24305972:C:G, 14:24306423:T:G, 14:24305974:T:TG, 14:24307411:T:C, 14:24306121:T:C, 14:24307516:C:T, 14:24306424:C:T, 14:24306039:G:C, 14:24307853:C:A, 14:24306388:A:G, 14:24305990:T:C, 14:24307822:G:GT, 14:24305640:G:A, 14:24307418:T:C, 14:24305758:G:C, 14:24306131:C:T, 14:24305953:A:G, 14:24305730:C:A, 14:24306418:A:G, 14:24306059:AC:A, 14:24307842:G:A, 14:24307837:T:G, 14:24306095:G:T, 14:24306109:C:T, 14:24307822:G:A, 14:24306077:G:A, 14:24307824:A:T, 14:24306080:C:T, 14:24305649:C:T, 14:24306433:G:GA, 14:24306420:G:C, 14:24305658:T:G, 14:24306472:C:T, 14:24307412:TC:T, 14:24306062:C:A, 14:24306044:G:C, 14:24306047:G:T, 14:24306126:CAG:C, 14:24306449:C:G, 14:24307391:G:A, or 14:24307857:A:C, according to GRCh38/hg38 human genome assembly coordinates.

The present disclosure also provides methods of treating a subject having a liver disease or at risk of developing a liver disease, wherein the subject is heterozygous or homozygous for a PNPLA3 variant nucleic acid molecule encoding PNPLA3 Ile148Met or Ile144Met polypeptide, the methods comprising administering to the subject: i) a CIDEB inhibitor; ii) a combination of a CIDEB inhibitor and a PNPLA3 inhibitor; iii) a combination of a CIDEB inhibitor and an HSD17B13 inhibitor; or iv) a combination of a CIDEB inhibitor, a PNPLA3 inhibitor, and an HSD17B13 inhibitor.

The present disclosure also provides methods of treating a subject having a liver disease or at risk of developing a liver disease, wherein: when the subject is homozygous for a nucleic acid molecule encoding a reference HSD17B13 polypeptide or a functional HSD17B13 polypeptide, the subject is administered: i) a CIDEB inhibitor in an amount that is the same as or greater than a standard dosage amount; ii) a combination of a CIDEB inhibitor in an amount that is the same as or greater than a standard dosage amount and a PNPLA3 inhibitor; iii) a combination of a CIDEB inhibitor in an amount that is the same as or greater than a standard dosage amount and an HSD17B13 inhibitor; or iv) a combination of a CIDEB inhibitor in an amount that is the same as or greater than a standard dosage amount, aPNPLA3 inhibitor, and an HSD17B13 inhibitor; and when the subject is not homozygous for a nucleic acid molecule encoding a reference HSD17B13 polypeptide or a functional HSD17B13 polypeptide (i.e., is a carrier for a loss-of-function HSD17B13), the subject is administered: i) a CIDEB inhibitor in an amount that is less than a standard dosage amount; ii) a combination of a CIDEB inhibitor in an amount that is less than a standard dosage amount and a PNPLA3 inhibitor; iii) a combination of a CIDEB inhibitor in an amount that is less than a standard dosage amount and an HSD17B13 inhibitor; or iv) a combination of a CIDEB inhibitor in an amount that is less than a standard dosage amount, aPNPLA3 inhibitor, and an HSD17B13 inhibitor.

The present disclosure also provides methods of treating a subject with a CIDEB inhibitor, wherein the subject has a liver disease or is at risk of developing a liver disease, the methods comprising: determining whether the subject has a PNPLA3 variant nucleic acid molecule encoding a PNPLA3 Ile148Met or Ile144Met polypeptide by: obtaining or having obtained a biological sample from the subject; and performing or having performed a sequence analysis on the biological sample to determine if the subject has a genotype comprising the PNPLA3 variant nucleic acid molecule; and administering or continuing to administer the CIDEB inhibitor in an amount that is the same as or greater than a standard dosage amount, or in combination with an HSD17B13 inhibitor and/or a PNPLA3 inhibitor to a subject that is heterozygous or homozygous for the PNPLA3 variant nucleic acid molecule; wherein the presence of a genotype having the PNPLA3 variant nucleic acid molecule encoding a PNPLA3 Ile148Met or Ile144Met polypeptide indicates that the subject is a candidate for treatment with the CIDEB inhibitor.

The present disclosure also provides methods of treating a subject with a CIDEB inhibitor, wherein the subject has a liver disease or is at risk of developing a liver disease, the methods comprising: determining whether the subject has a nucleic acid molecule encoding a reference HSD17B13 polypeptide or a functional HSD17B13 polypeptide by: obtaining or having obtained a biological sample from the subject; and performing or having performed a sequence analysis on the biological sample to determine if the subject has a genotype comprising the nucleic acid molecule encoding the reference HSD17B13 polypeptide or a functional HSD17B13 polypeptide; and administering or continuing to administer the CIDEB inhibitor, or in combination with an HSD17B13 inhibitor and/or a PNPLA3 inhibitor, to a subject that is heterozygous or homozygous for the nucleic acid molecule encoding the reference HSD17B13 polypeptide or a functional HSD17B13 polypeptide; wherein the presence of a genotype having the nucleic acid molecule encoding the reference HSD17B13 polypeptide or a functional HSD17B13 polypeptide indicates the subject is a candidate for treatment with the CIDEB inhibitor.

The present disclosure also provides methods of treating a subject, wherein the subject is overweight, obese, has increased body mass index (BMI), has a high percentage of liver fat, or has high adiposity, the methods comprising administering to the subject a CIDEB inhibitor, or a CIDEB inhibitor in combination with a PNPLA3 inhibitor and/or an HSD17B13 inhibitor.

BRIEF DESCRIPTION OF THE DRAWINGS

The patent or application file contains at least one drawing executed in color. Copies of this patent or patent application publication with color drawing(s) will be provided by the Office upon request and payment of the necessary fee.

The accompanying figures, which are incorporated in and constitute a part of this specification, illustrate several aspects and together with the description serve to explain the principles of the present disclosure.

DESCRIPTION

Figure 1:
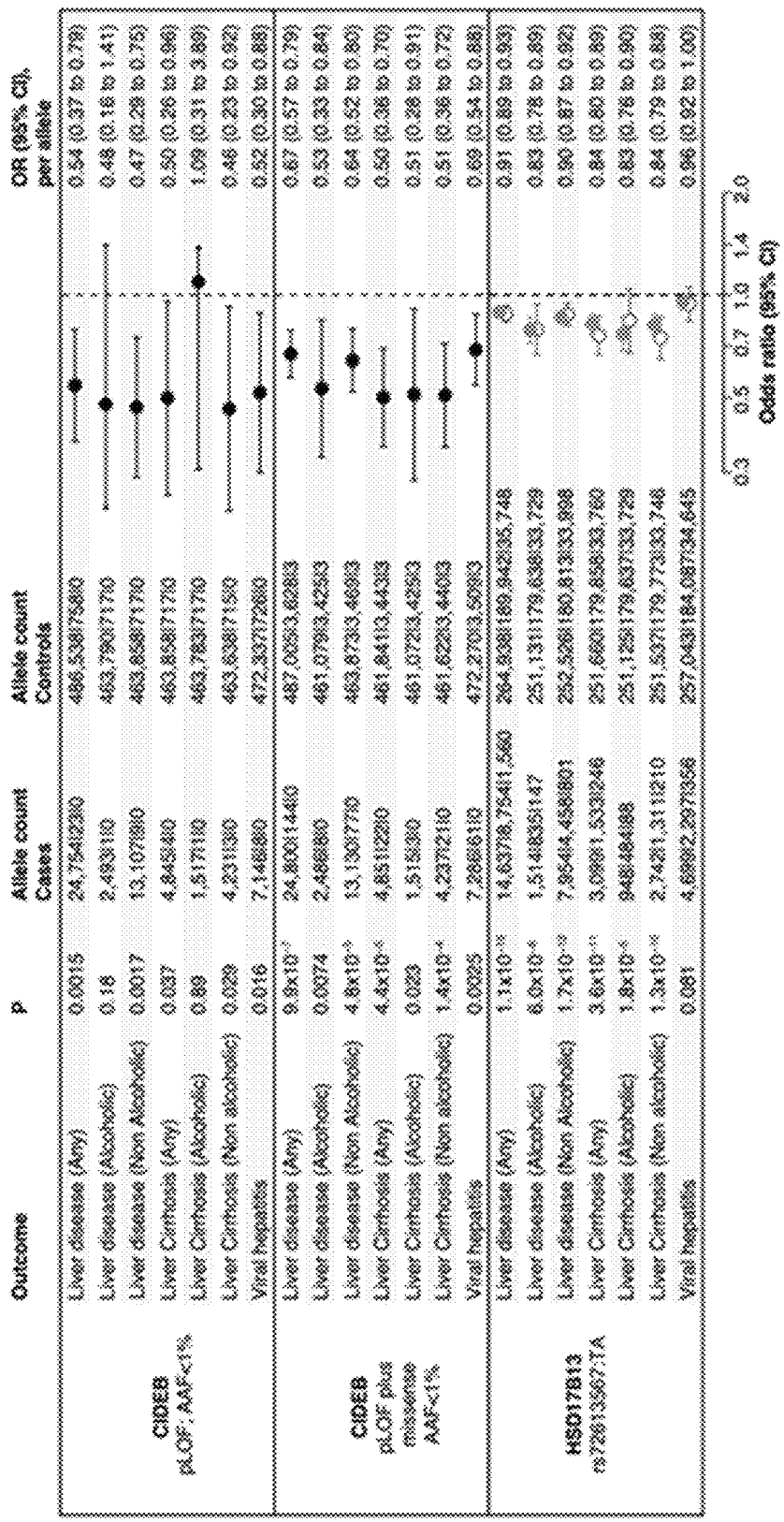
FIG. 1 shows an association of rare coding variants in CIDEB with liver disease risk. The Figure shows the association with liver disease across etiology and severity spectrum for rare pLOF variants in CIDEB (top), rare coding variants in CIDEB (middle) and the HSD17B13 splice variant (gray, heterozygous variant genotype compared with reference homozygous genotype; open circles, homozygous variant genotype compared with reference homozygous genotype). Abbreviations: OR; odds ratio, CI, confidence interval.

Various terms relating to aspects of the present disclosure are used throughout the specification and claims. Such terms are to be given their ordinary meaning in the art, unless otherwise indicated. Other specifically defined terms are to be construed in a manner consistent with the definitions provided herein.

Unless otherwise expressly stated, it is in no way intended that any method or aspect set forth herein be construed as requiring that its steps be performed in a specific order.

Accordingly, where a method claim does not specifically state in the claims or descriptions that the steps are to be limited to a specific order, it is in no way intended that an order be inferred, in any respect. This holds for any possible non-expressed basis for interpretation, including matters of logic with respect to arrangement of steps or operational flow, plain meaning derived from grammatical organization or punctuation, or the number or type of aspects described in the specification.

As used herein, the singular forms "a," "an" and "the" include plural referents unless the context clearly dictates otherwise.

As used herein, the term "about" means that the recited numerical value is approximate and small variations would not significantly affect the practice of the disclosed embodiments. Where a numerical value is used, unless indicated otherwise by the context, the term "about" means the numerical value can vary by ±10% and remain within the scope of the disclosed embodiments.

As used herein, the term "comprising" may be replaced with "consisting" or "consisting essentially of" in particular embodiments as desired.

As used herein, the terms "nucleic acid", "nucleic acid molecule", "nucleic acid sequence", "polynucleotide", or "oligonucleotide" can comprise a polymeric form of nucleotides of any length, can comprise DNA and/or RNA, and can be single-stranded, double-stranded, or multiple stranded. One strand of a nucleic acid also refers to its complement.

As used herein, the term "subject" includes any animal, including mammals. Mammals include, but are not limited to, farm animals (such as, for example, horse, cow, pig), companion animals (such as, for example, dog, cat), laboratory animals (such as, for example, mouse, rat, rabbits), and non-human primates (such as, for example, apes and monkeys). In some embodiments, the subject is a human. In some embodiments, the subject is a patient under the care of a physician.

It has been observed in accordance with the present disclosure that a gene burden of particular CIDEB variations (i.e., CIDEB variant nucleic acid molecules) associate with a decreased risk of developing a liver disease. It is believed that variants in CIDEB genes or proteins have not been significantly associated with liver disease or markers of liver damage in previous exome-sequencing association studies. Therefore, it is believed that humans having a liver disease or at risk of developing a liver disease may be treated with CIDEB inhibitors. Accordingly, the present disclosure provides methods for leveraging the identification of subjects who do not have such protective CIDEB variant nucleic acid molecules who, thus, are at risk of developing a liver disease, and to stratify the risk in such subjects of developing liver disease, such that subjects at risk or subjects with active disease may be treated with CIDEB inhibitors.

In any of the embodiments described herein, the CIDEB variant nucleic acid molecules can be any CIDEB nucleic acid molecule (such as, for example, genomic nucleic acid molecule, mRNA molecule, or cDNA molecule) encoding a CIDEB polypeptide having a partial loss-of-function, a complete loss-of-function, a predicted partial loss-of-function, or a predicted complete loss-of-function, or encoding a missense polypeptide, or resulting in the absence of an encoded polypeptide, or having an impact on the CIDEB mRNA sequence or expression. For example, the CIDEB variant nucleic acid molecules can be any of the CIDEB variant nucleic acid molecules described herein. A CIDEB variant nucleic acid molecule can be a variant that is predicted to result in the premature truncation of the CIDEB polypeptide (including, but not limited to, frameshift mutations, insertions or deletions, stop-gain, stop-lost, start-lost, splice site variants or large chromosomal or sub-chromosomal re-arrangements affecting the CIDEB gene). CIDEB variant nucleic acid molecules can include, but are not limited to, in-frame insertions or deletions in the CIDEB gene or variants in the untranslated regions of the CIDEB gene. A missense variant is a variant predicted to result in the change of an amino acid sequence of the CIDEB polypeptide.

For purposes of the present disclosure, any particular subject, such as a human, can be categorized as having one of three CIDEB genotypes: i) CIDEB reference; ii) heterozygous for a CIDEB variant nucleic acid molecule, and iii) homozygous for a CIDEB variant nucleic acid molecule. A subject is CIDEB reference when the subject does not have a copy of a CIDEB variant nucleic acid molecule. A subject is heterozygous for a CIDEB variant nucleic acid molecule when the subject has a single copy of a CIDEB variant nucleic acid molecule. A CIDEB variant nucleic acid molecule is any CIDEB nucleic acid molecule (such as, a genomic nucleic acid molecule, an mRNA molecule, or a cDNA molecule) encoding a CIDEB polypeptide having a partial loss-of-function, a complete loss-of-function, a predicted partial loss-of-function, or a predicted complete loss-of-function, or encoding a missense polypeptide, or having an impact on the CIDEB mRNA sequence. A subject who has a CIDEB polypeptide having a partial loss-of-function (or predicted partial loss-of-function, or a missense) is hypomorphic for CIDEB (lower abundance or function of the gene compared to the reference sequence version). The CIDEB variant nucleic acid molecule can be any variant nucleic acid molecule described herein. A subject is homozygous for a CIDEB variant nucleic acid molecule when the subject has two copies of any of the CIDEB variant nucleic acid molecules.

For subjects that are genotyped or determined to be heterozygous or homozygous for a CIDEB variant nucleic acid molecule, such subjects have a decreased risk of developing a liver disease compared to CIDEB reference subjects. For subjects that are genotyped or determined to be CIDEB reference, such subjects have an increased risk of developing a liver disease compared to carriers of the aforementioned CIDEB variants. For subjects that are genotyped or determined to be CIDEB reference or are heterozygous for a CIDEB variant nucleic acid molecule, such subjects can be treated with one or more CIDEB inhibitors. Such subjects can also be treated with therapeutic agents used to treat a liver disease. For subjects that are genotyped or determined to be CIDEB reference or are heterozygous for a CIDEB variant nucleic acid molecule, such subjects can also be treated with a combination of a CIDEB inhibitor and a PNPLA3 inhibitor and/or an HSD17B13 inhibitor.

For subjects that are genotyped or determined to be CIDEB reference and are carriers of a PNPLA3 variant nucleic acid molecule encoding PNPLA3 Ile148Met or Ile144Met, such subjects have an increased risk of developing a liver disease compared to subjects who are either CIDEB reference or carriers of the aforementioned CIDEB variant types, but do not carry a PNPLA3 variant nucleic acid molecule encoding PNPLA3 Ile148Met or Ile144Met (PNPLA3 reference). For subjects that are genotyped or determined to be CIDEB reference or are heterozygous for a CIDEB variant nucleic acid molecule and to be carriers of a PNPLA3 variant nucleic acid molecule encoding PNPLA3 Ile148Met or Ile144Met, such subjects can be treated with a combination of one or more CIDEB inhibitors and/or one or more PNPLA3 inhibitors. Such subjects can also be treated with therapeutic agents used to treat a liver disease. Such subjects can also be treated with an HSD17B13 inhibitor.

For subjects that are genotyped or determined to be CIDEB reference and are carriers of a nucleic acid molecule encoding a reference HSD17B13 polypeptide or a functional HSD17B13 polypeptide, such subjects have an increased risk of developing a liver disease compared to subjects who are either CIDEB reference or heterozygous carriers of the aforementioned CIDEB variants, but do not carry a nucleic acid molecule encoding a reference HSD17B13 polypeptide or a functional HSD17B13 polypeptide. For subjects that are genotyped or determined to be CIDEB reference or are heterozygous for a CIDEB variant nucleic acid molecule and to be carriers of a nucleic acid molecule encoding a reference HSD17B13 polypeptide or a functional HSD17B13 polypeptide, such subjects can be treated with a combination of one or more CIDEB inhibitors and/or one or more HSD17B13 inhibitors. Such subjects can also be treated with therapeutic agents used to treat a liver disease. Such subjects can also be treated with a PNPLA3 inhibitor.

In any of the embodiments described herein, the CIDEB variant nucleic acid molecule can be any nucleic acid molecule (such as, for example, genomic nucleic acid molecule, mRNA molecule, or cDNA molecule) encoding a CIDEB polypeptide having a partial loss-of-function, a complete loss-of-function, a predicted partial loss-of-function, or a predicted complete loss-of-function, or encoding a missense polypeptide, or having an impact on the CIDEB mRNA sequence. In some embodiments, the CIDEB variant nucleic acid molecule is a variant that causes or is predicted to cause a nonsynonymous amino acid substitution in CIDEB and whose allele frequency is less than 1/100 alleles in the population from which the subject is selected. In some embodiments, the CIDEB variant nucleic acid molecule is any rare missense variant (allele frequency <1%; or 1 in 100 alleles) or any missense variant predicted or demonstrated to result in a change in CIDEB polypeptide sequence, folding, structure, abundance or function regardless of frequency, or any splice-site, stop-gain, start-loss, stop-loss, frameshift, or in-frame indel, or other frameshift CIDEB variant or any other variant predicted or demonstrated to result in a change in the amino acid sequence of the CIDEB polypeptide. In some embodiments, the subject has one or more of the following CIDEB variant nucleic acid molecules: 14:24305635:A:AGTAG, 14:24305641:A:C, 14:24305650:G:A, 14:24305657:C:A, 14:24305662:G:T, 14:24305667:T:C, 14:24305671:C:A, 14:24305671:C:G, 14:24305701:A:T, 14:24305709:C:T, 14:24305718:A:G, 14:24305721:T:C, 14:24305728:G:GGCCTT, 14:24305743:T:C, 14:24305948:T:C, 14:24305966:C:T, 14:24305974:T:C, 14:24305980:TCA:T, 14:24305988:C:T, 14:24306014:C:T, 14:24306034:A:C, 14:24306041:C:G, 14:24306044:G:A, 14:24306047:G:A, 14:24306051:T:G, 14:24306064:T:C, 14:24306074:A:G, 14:24306077:G:C, 14:24306082:A:G, 14:24306083:T:A, 14:24306095:G:A, 14:24306122:A:G, 14:24306134:C:G, 14:24306373:C:G, 14:24306379:T:C, 14:24306382:G:A, 14:24306383:G:T, 14:24306426:T:G, 14:24306437:C:G, 14:24306439:G:C, 14:24306442:A:G, 14:24306444:A:G, 14:24306457:C:T, 14:24306463:C:T, 14:24306469:C:T, 14:24306480:A:G, 14:24306486:A:C, 14:24306504:A:G, 14:24306519:A:G, 14:24307382:G:C, 14:24307405:A:G, 14:24307417:A:T, 14:24307421:T:A, 14:24307441:C:A, 14:24307444:A:C, 14:24307444:A:G, 14:24307450:CGCTG, 14:24307461:TG:T, 14:24307469:AG:A, 14:24307474:C:T, 14:24307475:A:G, 14:24307833:G:C, 14:24307851:T:TAC, 14:24306426:T:C, 14:24307849:G:C, 14:24307448:G:T, 14:24305671:C:T, 14:24305663:C:T, 14:24305686:C:G, 14:24307829:A:C, 14:24307818:CTGAG:C, 14:24307856:C:T, 14:24306423:T:C, 14:24306061:AC:A, 14:24307390:C:T, 14:24306382:G:T, 14:24306373:C:T, 14:24305733:T:C, 14:24307858:T:C, 14:24306387:C:T, 14:24305637:T:C, 14:24306062:C:T, 14:24307853:C:G, 14:24307450:C:G, 14:24306052:TG:T, 14:24305673:G:A, 14:24306043:C:T, 14:24307834:G:A, 14:24306417:C:T, 14:24307451:G:A, 14:24307436:A:C, 14:24305953:ACTTT:A, 14:24306489:G:T, 14:24307441:C:T, 14:24306375:C:T, 14:24305657:C:G, 14:24306427:C:T, 14:24306524:C:T, 14:24307516:C:A, 14:24307840:G:C, 14:24307501:A:G, 14:24305968:A:C, 14:24305986:C:T, 14:24307441:C:G, 14:24307459:G:T, 14:24306017:T:A, 14:24307424:G:A, 14:24306072:G:T, 14:24307423:C:T, 14:24307450:C:T, 14:24306420:G:A, 14:24307454:G:A, 14:24305653:C:T, 14:24307442:G:A, 14:24306002:C:T, 14:24306076:C:T, 14:24305664:C:T, 14:24305961:TG:T, 14:24305706:A:G, 14:24305946:C:T, 14:24306455:G:C, 14:24307468:G:A, 14:24307825:A:C, 14:24306110:G:A, 14:24305710:C:T, 14:24307483:C:T, 14:24306459:A:G, 14:24305754:C:T, 14:24305650:G:C, 14:24305691:C:T, 14:24306508:G:C, 14:24306039:G:T, 14:24306139:T:C, 14:24306391:T:C, 14:24306373:C:A, 14:24307498:C:T, 14:24307415:G:A, 14:24306138:CTG:C, 14:24307453:T:C, 14:24305692:G:A, 14:24305683:C:G, 14:24307484:G:A, 14:24307385:C:T, 14:24306519:A:T, 14:24307839:A:C, 14:24305965:C:T, 14:24305988:CAT:C, 14:24306087:C:G, 14:24307439:C:T, 14:24307477:A:C, 14:24306436:G:T, 14:24306507:A:G, 14:24307397:C:T, 14:24307495:G:A, 14:24306034:A:T, 14:24306013:G:A, 14:24307381:A:G, 14:24306383:G:C, 14:24305638:A:G, 14:24307420:G:A, 14:24306020:C:T, 14:24306470:A:C, 14:24307435:C:T, 14:24306469:C:G, 14:24306451:C:T, 14:24306403:G:A, 14:24307515:C:G, 14:24307489:A:G, 14:24307414:C:T, 14:24306483:A:G, 14:24305755:G:A, 14:24305766:C:T, 14:24306064:T:G, 14:24307516:C:G, 14:24305766:C:G, 14:24306489:G:A, 14:24306097:T:C, 14:24305763:T:G, 14:24307447:G:A, 14:24307402:G:A, 14:24305972:C:G, 14:24306423:T:G, 14:24305974:T:TG, 14:24307411:T:C, 14:24306121:T:C, 14:24307516:C:T, 14:24306424:C:T, 14:24306039:G:C, 14:24307853:C:A, 14:24306388:A:G, 14:24305990:T:C, 14:24307822:G:GT, 14:24305640:G:A, 14:24307418:T:C, 14:24305758:G:C, 14:24306131:C:T, 14:24305953:A:G, 14:24305730:C:A, 14:24306418:A:G, 14:24306059:AC:A, 14:24307842:G:A, 14:24307837:T:G, 14:24306095:G:T, 14:24306109:C:T, 14:24307822:G:A, 14:24306077:G:A, 14:24307824:A:T, 14:24306080:C:T, 14:24305649:C:T, 14:24306433:G:GA, 14:24306420:G:C, 14:24305658:T:G, 14:24306472:C:T, 14:24307412:TC:T, 14:24306062:C:A, 14:24306044:G:C, 14:24306047:G:T, 14:24306126:CAG:C, 14:24306449:C:G, 14:24307391:G:A, or 14:24307857:A:C (according to GRCh38/hg38 human genome assembly coordinates).

In any of the embodiments described herein, the CIDEB variant nucleic acid molecules have one or more variations at the indicated positions of chromosome 14 using the nucleotide sequence of the CIDEB reference genomic nucleic acid molecule (SEQ ID NO:1; ENSG00000136305.11 in the GRCh38/hg38 human genome assembly, for which position 24,311,422 of chromosome 14 is the first nucleotide in SEQ ID NO:1).

In any of the embodiments described herein, the CIDEB variant nucleic acid molecules can be mRNA and cDNA molecules having the corresponding variant positions referring to the reference genomic sequence as a reference sequence.

The nucleotide sequences of CIDEB reference mRNA molecules produced through alternative splicing are set forth in SEQ ID NOs:2-12. The variant nucleotides at their respective variant positions for the variant genomic nucleic acid molecules described herein also have corresponding variant nucleotides at their respective variant positions for the variant mRNA molecules based upon the CIDEB reference mRNA sequences according to SEQ ID NOs:2-12. Any of these CIDEB variant mRNA molecules can be detected in any of the methods described herein.

The nucleotide sequences of CIDEB reference cDNA molecules produced through alternative splicing are set forth in SEQ ID NOs:13-23. The variant nucleotides at their respective variant positions for the variant genomic nucleic acid molecules described herein also have corresponding variant nucleotides at their respective variant positions for the variant cDNA molecules based upon the CIDEB reference cDNA sequences according to SEQ ID NOs:13-23. Any of these CIDEB variant cDNA molecules can be detected in any of the methods described herein.

The amino acid sequence of a CIDEB reference polypeptide is set forth in SEQ ID NO:24. Using the translated nucleotide sequence of either the CIDEB mRNA or cDNA molecules, the CIDEB variant polypeptides have corresponding translated variant amino acids at variant positions. Any of these CIDEB predicted loss-of-function polypeptides can be detected in any of the methods described herein.

The nucleotide and amino acid sequences listed in the accompanying sequence listing are shown using standard letter abbreviations for nucleotide bases, and three-letter code for amino acids. The nucleotide sequences follow the standard convention of beginning at the 5' end of the sequence and proceeding forward (i.e., from left to right in each line) to the 3' end. Only one strand of each nucleotide sequence is shown, but the complementary strand is understood to be included by any reference to the displayed strand. The amino acid sequence follows the standard convention of beginning at the amino terminus of the sequence and proceeding forward (i.e., from left to right in each line) to the carboxy terminus.

As used herein, the phrase "corresponding to" or grammatical variations thereof when used in the context of the numbering of a particular nucleotide or nucleotide sequence or position refers to the numbering of a specified reference sequence when the particular nucleotide or nucleotide sequence is compared to a reference sequence. In other words, the residue (such as, for example, nucleotide or amino acid) number or residue (such as, for example, nucleotide or amino acid) position of a particular polymer is designated with respect to the reference sequence rather than by the actual numerical position of the residue within the particular nucleotide or nucleotide sequence. For example, a particular nucleotide sequence can be aligned to a reference sequence by introducing gaps to optimize residue matches between the two sequences. In these cases, although the gaps are present, the numbering of the residue in the particular nucleotide or nucleotide sequence is made with respect to the reference sequence to which it has been aligned. A variety of computational algorithms exist that can be used for performing a sequence alignment to identify a nucleotide or amino acid position in one polymeric molecule that corresponds to a nucleotide or amino acid position in another polymeric molecule. For example, by using the NCBI BLAST algorithm (Altschul et al., Nucleic Acids Res., 1997, 25, 3389-3402) or CLUSTALW software (Sievers and Higgins, Methods Mol. Biol., 2014, 1079, 105-116) sequence alignments may be performed. However, sequences can also be aligned manually.

Any one or more (i.e., any combination) of the variants recited herein can be used within any of the methods described herein to determine whether a subject has an increased or decreased risk of developing a liver disease. The combinations of particular variants can form a gene-burden or "mask" used for statistical analysis of the particular correlation of CIDEB and higher or lower risk of developing a liver disease or liver damage (e.g., as quantified by liver biomarkers or imaging related variables).

In any of the embodiments described herein, the CIDEB predicted loss-of-function polypeptide can be any CIDEB polypeptide having a partial loss-of-function, a complete loss-of-function, a predicted partial loss-of-function, or a predicted complete loss-of-function, or missense polypeptide.

In any of the embodiments described herein, the liver disease is a fatty liver disease (such as, for example, alcoholic fatty liver disease (AFLD), non-alcoholic fatty liver disease (NAFLD) or non-alcoholic steatohepatitis (NASH)), liver cirrhosis, liver fibrosis, an increased liver enzyme (such as, for example, alanine transaminase (ALT) or aspartate transaminase (AST)), simple steatosis, steatohepatitis, parenchymal liver disease, viral hepatitis, or hepatocellular carcinoma, or any of the complications of such conditions (including, but not limited to, heart or metabolic disease related to NASH or NAFLD, portal vein hypertension or thrombosis, esophageal or gastric varices or bleeding from those varices, and other liver-disease related co-morbidities). In some embodiments, the liver disease is a fatty liver disease. In some embodiments, the liver disease is AFLD. In some embodiments, the liver disease is NAFLD. In some embodiments, the liver disease is NASH. In some embodiments, the liver disease is liver cirrhosis. In some embodiments, the liver disease is liver fibrosis. In some embodiments, the liver disease is an increased liver enzyme. In some embodiments, the liver disease is increased ALT. In some embodiments, the liver disease is increased AST. In some embodiments, the liver disease is simple steatosis. In some embodiments, the liver disease is steatohepatitis. In some embodiments, the liver disease is parenchymal liver disease. In some embodiments, the liver disease is viral hepatitis. In some embodiments, the liver disease is hepatocellular carcinoma. In some embodiments, the liver disease is liver damage quantified by a liver biomarker (e.g., liver transaminase), a change in a liver biomarker, by liver imaging, or by liver histology.

Symptoms of liver disease include, but are not limited to, enlarged liver, fatigue, pain in the upper right abdomen, abdominal swelling (ascites), enlarged blood vessels just beneath the skin's surface, enlarged breasts in men, enlarged spleen, red palms, and yellowing of the skin and eyes (jaundice), pruritus, dark urine color, pale stool color nausea or vomiting, loss of appetite, and tendency to bruise easily. Testing for liver diseases can involve blood tests, imaging of the liver, and biopsy of the liver. An individual is at increased risk of a liver disease if the subject has at least one known risk-factor (e.g., genetic factor such as a disease-causing mutation) placing individuals with that risk factor at a statistically significant greater risk of developing the disease than individuals without the risk factor. Risk factors for liver diseases are also well known and can include, for example, excessive alcohol use, obesity, high cholesterol, high levels of triglycerides in the blood, polycystic ovary syndrome, sleep apnea, type 2 diabetes, underactive thyroid (hypothyroidism), underactive pituitary gland (hypopituitarism), and metabolic syndromes including raised blood lipids.

The present disclosure provides methods of treating a subject having a liver disease or at risk of developing a liver disease, the methods comprising administering a CIDEB inhibitor to the subject.

The present disclosure also provides methods of treating a subject having a liver disease or at risk of developing a liver disease, wherein the subject is heterozygous or homozygous for a nucleic acid molecule encoding PNPLA3 Ile148Met or Ile144Met, the methods comprising administering: i) a CIDEB inhibitor in an amount that is the same as or greater than a standard dosage amount; ii) a combination of a CIDEB inhibitor in an amount that is the same as or greater than a standard dosage amount and a PNPLA3 inhibitor; iii) a combination of a CIDEB inhibitor in an amount that is the same as or greater than a standard dosage amount and an HSD17B13 inhibitor; or iv) a combination of a CIDEB inhibitor in an amount that is the same as or greater than a standard dosage amount, aPNPLA3 inhibitor, and an HSD17B13 inhibitor.

The present disclosure also provides methods of treating a subject having a liver disease or at risk of developing a liver disease, wherein: when the subject is homozygous for a nucleic acid molecule encoding a reference HSD17B13 polypeptide or a functional HSD17B13 polypeptide, the subject is administered: i) a CIDEB inhibitor in an amount that is the same as or greater than a standard dosage amount; ii) a combination of a CIDEB inhibitor in an amount that is the same as or greater than a standard dosage amount and a PNPLA3 inhibitor; iii) a combination of a CIDEB inhibitor in an amount that is the same as or greater than a standard dosage amount and an HSD17B13 inhibitor; or iv) a combination of a CIDEB inhibitor in an amount that is the same as or greater than a standard dosage amount, aPNPLA3 inhibitor, and an HSD17B13 inhibitor; and when the subject is not homozygous for a nucleic acid molecule encoding a reference HSD17B13 polypeptide or a functional HSD17B13 polypeptide (i.e., is a carrier for a loss-of-function HSD17B13), the subject is administered: i) a CIDEB inhibitor in an amount that is less than a standard dosage amount; ii) a combination of a CIDEB inhibitor in an amount that is less than a standard dosage amount and a PNPLA3 inhibitor; iii) a combination of a CIDEB inhibitor in an amount that is less than a standard dosage amount and an HSD17B13 inhibitor; or iv) a combination of a CIDEB inhibitor in an amount that is less than a standard dosage amount, aPNPLA3 inhibitor, and an HSD17B13 inhibitor.

The present disclosure also provides methods of treating a subject having a liver disease or at risk of developing a liver disease, wherein the subject is heterozygous or homozygous for a nucleic acid molecule encoding a PNPLA3 Ile148Met or Ile144Met polypeptide and is heterozygous or homozygous for a nucleic acid molecule encoding a reference HSD17B13 polypeptide or a functional HSD17B13 polypeptide, the methods comprising administering a combination of a CIDEB inhibitor, a PNPLA3 inhibitor, and/or an HSD17B13 inhibitor to the subject.

In these methods, the subject can have any one or more of the liver diseases disclosed herein. In some embodiments, the liver disease is a fatty liver disease. In some embodiments, the liver disease is NAFLD or NASH. In some embodiments, the liver disease is NAFLD. In some embodiments, the liver disease is NASH. In some embodiments, the liver disease is liver cirrhosis. In some embodiments, the liver disease is fibrosis. In some embodiments, the liver disease is an increased liver enzyme. In some embodiments, the liver enzyme is ALT. In some embodiments, the liver enzyme is AST.

The present disclosure also provides methods of treating a subject having a liver disease or at risk of developing a liver disease, the methods comprising determining a nonalcoholic fatty liver disease (NAFLD) activity score (or NASH-CRN nonalcoholic fatty-liver disease activity score or NAS (NASH-CRN nonalcoholic fatty-liver disease activity score)), and when the NAFLD activity score is greater than a pre-determined score, administering to the subject a CIDEB inhibitor, a PNPLA3 inhibitor, or an HSD17B13 inhibitor, or any combination thereof, as described herein. The NAFLD activity score is defined by histological examinations from liver biopsies and scored based on the NASH Clinical Research Network system: steatosis Grade 0 (<5% parenchymal involvement), steatosis Grade 1 (5 to <34%), steatosis Grade 2 (34 to <67%), and steatosis Grade 3 (>67%); lobular inflammation Grade 0 (no foci), lobular inflammation Grade 1 (mild, <2 foci per 200× field), lobular inflammation Grade 2 (moderate, 2-4 foci per 200× field), lobular inflammation Grade 3 (severe, >4 foci per 200× field); ballooning Grade 0 (none), ballooning Grade 1 (few balloon cells), ballooning Grade 2 (many cells/prominent ballooning); fibrosis Stage 0 (none), fibrosis Stage 1 (perisinusoidal or periportal fibrosis), fibrosis Stage 2 (perisinusoidal and periportal fibrosis), fibrosis Stage 3 (bridging fibrosis), and fibrosis Stage 4 (cirrhosis). 5) Nonalcoholic fatty liver disease (NAFLD) activity score (NAS) defined as the unweighted sum of the scores for steatosis (0-3), lobular inflammation (0-3), and ballooning (0-2), thus ranging from 0-8. In some embodiments, the pre-determined NAFLD activity score is greater than 0. In some embodiments, the pre-determined NAFLD activity score is greater than 1. In some embodiments, the pre-determined NAFLD activity score is greater than 2. In some embodiments, the pre-determined NAFLD activity score is greater than 3. In some embodiments, the pre-determined NAFLD activity score is greater than 4. In some embodiments, the pre-determined NAFLD activity score is greater than 5.

In some embodiments, the CIDEB inhibitor comprises an inhibitory nucleic acid molecule. Examples of inhibitory nucleic acid molecules include, but are not limited to, antisense nucleic acid molecules, small interfering RNAs (siRNAs), and short hairpin RNAs (shRNAs). Such inhibitory nucleic acid molecules can be designed to target any region of a CIDEB mRNA. In some embodiments, the antisense RNA, siRNA, or shRNA hybridizes to a sequence within a CIDEB genomic nucleic acid molecule or mRNA molecule and decreases expression of the CIDEB polypeptide in a cell in the subject. In some embodiments, the CIDEB inhibitor comprises an antisense RNA that hybridizes to a CIDEB genomic nucleic acid molecule or mRNA molecule and decreases expression of the CIDEB polypeptide in a cell in the subject. In some embodiments, the CIDEB inhibitor comprises an siRNA that hybridizes to a CIDEB genomic nucleic acid molecule or mRNA molecule and decreases expression of the CIDEB polypeptide in a cell in the subject. In some embodiments, the CIDEB inhibitor comprises an shRNA that hybridizes to a CIDEB genomic nucleic acid molecule or mRNA molecule and decreases expression of the CIDEB polypeptide in a cell in the subject.

The inhibitory nucleic acid molecules described herein can be targeted to various CIDEB transcripts. For example, the inhibitory nucleic acid molecules described herein can be targeted to the CIDEB transcripts (derived from chromosome 14; Ensembl Gene ID=ENSG00000136305; hgnc symbol=CIDEB; from top to bottom=Transcript A, Transcript B, Transcript C, Transcript D, Transcript E, and Transcript F) in Table 1.

TABLE 1

| Ensembl Transcript id | Transcript Start | Transcript End | Name | Coordinates | Length |
|---|---|---|---|---|---|
| ENST00000258807 | 24305187 | 24311422 | CIDEB_258807 | chr14: 24311422-24305187 | 6235 |
| ENST00000336557 | 24305187 | 24311395 | CIDEB_336557 | chr14: 24311395-24305187 | 6208 |
| ENST00000554411 | 24305096 | 24308263 | CIDEB_554411 | chr14: 24308263-24305096 | 3167 |
| ENST00000555471 | 24310087 | 24310718 | CIDEB_555471 | chr14: 24310718-24310087 | 631 |
| ENST00000555817 | 24310799 | 24311430 | CIDEB_555817 | chr14: 24311430-24310799 | 631 |
| ENST00000556756 | 24305606 | 24306461 | CIDEB_556756 | chr14: 24306461-24305606 | 855 |

Additional CIDEB transcripts include, but are not limited to those of the following Ensembl Gene IDs=ENST00000555471, ENST00000555817, ENST00000556756, ENST00000258807, ENS100000336557, and ENST00000554411.

In some embodiments, the antisense nucleic acid molecules targeted to Transcript A comprise or consist of the nucleotide sequences shown in Table 2.

TABLE 2

| Sequence | SEQ ID NO: |
|---|---|
| ACCACGCAGUCAACCUUCUG | 115 |
| UACCACGCAGUCAACCUUCU | 116 |
| CUACCACGCAGUCAACCUUC | 117 |
| CCUACCACGCAGUCAACCUU | 118 |
| CCCUACCACGCAGUCAACCU | 119 |
| UUGCCUUCGGCUUGCUCUGG | 120 |
| CUUGCCUUCGGCUUGCUCUG | 121 |
| GCUUGCCUUCGGCUUGCUCU | 122 |
| UGCUUGCCUUCGGCUUGCUC | 123 |
| GUGCUUGCCUUCGGCUUGCU | 124 |
| UCGUGCUUGCCUUCGGCUUG | 125 |
| AUCGUGCUUGCCUUCGGCUU | 126 |
| CAUCGUGCUUGCCUUCGGCU | 127 |
| AGCGCCAUCGUGCUUGCCUU | 128 |
| UGGUGAGCGCCAUCGUGCUU | 129 |
| CUGAUGCUCGGCUGCUACAG | 130 |
| GCUGAUGCUCGGCUGCUACA | 131 |
| UUUCGGGCUGAUGCUCGGCU | 132 |
| UCCUUUCGGGCUGAUGCUCG | 133 |
| UUCCUUUCGGGCUGAUGCUC | 134 |
| CUUCCUUUCGGGCUGAUGCU | 135 |
| GCUUCCUUUCGGGCUGAUGC | 136 |
| UGCUUCCUUUCGGGCUGAUG | 137 |
| GUGCUUCCUUUCGGGCUGAU | 138 |
| CGUGCUUCCUUUCGGGCUGA | 139 |
| UCGUGCUUCCUUUCGGGCUG | 140 |
| UUCGUGCUUCCUUUCGGGCU | 141 |
| UUUCGUGCUUCCUUUCGGGC | 142 |
| CUUUCGUGCUUCCUUUCGGG | 143 |
| GCUUUCGUGCUUCCUUUCGG | 144 |
| AUGUACGCCAGCGUGCUGCU | 145 |
| UCAGCAUGUACGCCAGCGUG | 146 |
| AGGCGGUGUACUACGUGUGC | 147 |
| AAGGCGGUGUACUACGUGUG | 148 |
| CAAGGCGGUGUACUACGUGU | 149 |
| GCAAGGCGGUGUACUACGUG | 150 |
| UGCAAGGCGGUGUACUACGU | 151 |
| CUGCAAGGCGGUGUACUACG | 152 |
| GCUGCAAGGCGGUGUACUAC | 153 |
| GGCUGCAAGGCGGUGUACUA | 154 |
| GCUCUUUGUGGCCUUCCUGA | 155 |
| CGCUCUUUGUGGCCUUCCUG | 156 |
| CUUCGUGGUGUGGAGCUUGG | 157 |
| GGCUUCGUGGUGUGGAGCUU | 158 |
| CAACGGCUUCGUGGUGUGGA | 159 |
| UGGCAACGGCUUCGUGGUGU | 160 |
| UGAGCUGGAAGACUUCGCGG | 161 |
| CUGAGCUGGAAGACUUCGCG | 162 |
| GCUGAGCUGGAAGACUUCGC | 163 |
| ACACUGCUGAGCUGGAAGAC | 164 |

TABLE 2-continued

| Sequence | SEQ ID NO: |
|---|---|
| CGAGACACUGCUGAGCUGGA | 165 |
| ACGAGACACUGCUGAGCUGG | 166 |
| AACGAGACACUGCUGAGCUG | 167 |
| GAACGAGACACUGCUGAGCU | 168 |
| GGAACGAGACACUGCUGAGC | 169 |
| GGGAACGAGACACUGCUGAG | 170 |
| AGGGAACGAGACACUGCUGA | 171 |
| CAGGGAACGAGACACUGCUG | 172 |
| CCAGGGAACGAGACACUGCU | 173 |
| AAGGAUGUCGGUCUGCUACC | 174 |
| GAAGGAUGUCGGUCUGCUAC | 175 |
| AGAAGGAUGUCGGUCUGCUA | 176 |
| UAGGCCCAGAAGGAUGUCGG | 177 |
| GUAGGCCCAGAAGGAUGUCG | 178 |
| UGUAGGCCCAGAAGGAUGUC | 179 |
| CUGUAGGCCCAGAAGGAUGU | 180 |
| CCUGUAGGCCCAGAAGGAUG | 181 |
| ACCUGUAGGCCCAGAAGGAU | 182 |
| CUUCUCAUCGGGCAUCACAG | 183 |
| CCUUCUCAUCGGGCAUCACA | 184 |
| ACCUUCUCAUCGGGCAUCAC | 185 |
| CACCUUCUCAUCGGGCAUCA | 186 |
| GCACCUUCUCAUCGGGCAUC | 187 |
| GGCACCUUCUCAUCGGGCAU | 188 |
| UGGCACCUUCUCAUCGGGCA | 189 |
| AUGGCACCUUCUCAUCGGGC | 190 |
| CAUGGCACCUUCUCAUCGGG | 191 |
| GCAUGGCACCUUCUCAUCGG | 192 |
| GGCAUGGCACCUUCUCAUCG | 193 |
| GAGGCAUGGCACCUUCUCAU | 194 |
| GGAGGCAUGGCACCUUCUCA | 195 |
| GACUCCCAGGCAGAAAAGAG | 196 |
| GGACUCCCAGGCAGAAAAGA | 197 |
| AGGACUCCCAGGCAGAAAAG | 198 |
| UCAGGACUCCCAGGCAGAAA | 199 |
| GAAGUCAGGACUCCCAGGCA | 200 |
| GUGGAAGUCAGGACUCCCAG | 201 |
| UCGUGGAAGUCAGGACUCCC | 202 |
| CUCGUGGAAGUCAGGACUCC | 203 |
| CCUCGUGGAAGUCAGGACUC | 204 |
| UGGGUCCUCGUGGAAGUCAG | 205 |
| CUGGGUCCUCGUGGAAGUCA | 206 |
| UCUGGGUCCUCGUGGAAGUC | 207 |
| GUCUGGGUCCUCGUGGAAGU | 208 |
| AAGAAGGAGUUGUGUUUGAG | 209 |
| CCAAGAAGGAGUUGUGUUUG | 210 |
| GUUCCAAGAAGGAGUUGUGU | 211 |
| GGUUCCAAGAAGGAGUUGUG | 212 |
| CAGGUCAACUGACUGGGAGC | 213 |
| UGCCUGUUUACCACUGAGCU | 214 |
| AUGCCUGUUUACCACUGAGC | 215 |
| UAUGCCUGUUUACCACUGAG | 216 |
| UUAUGCCUGUUUACCACUGA | 217 |
| UUUAUGCCUGUUUACCACUG | 218 |
| CUUUAUGCCUGUUUACCACU | 219 |
| ACUUUAUGCCUGUUUACCAC | 220 |
| UAGAGAUAGUGACAGCCUGG | 221 |
| GUAGAGAUAGUGACAGCCUG | 222 |
| UGGUGGUAGAGAUAGUGACA | 223 |
| GUGGUGGUAGAGAUAGUGAC | 224 |
| UAGAGGAGUGGUGGUAGAGA | 225 |
| ACUAGAGGAGUGGUGGUAGA | 226 |
| AGACUAGAGGAGUGGUGGUA | 227 |
| CAGACUAGAGGAGUGGUGGU | 228 |
| CCAGACUAGAGGAGUGGUGG | 229 |
| GCCAGACUAGAGGAGUGGUG | 230 |
| GGCCAGACUAGAGGAGUGGU | 231 |
| GCCCAGAUGUGCUAGAAUGG | 232 |
| UGCCCAGAUGUGCUAGAAUG | 233 |
| UUGCCCAGAUGUGCUAGAAU | 234 |
| UUUGCCCAGAUGUGCUAGAA | 235 |
| UUUUGCCCAGAUGUGCUAGA | 236 |
| CCAGUUUUGCCCAGAUGUGC | 237 |
| AUCCAGUUUUGCCCAGAUGU | 238 |
| CCAUCCAGUUUUGCCCAGAU | 239 |
| CACCAUCCAGUUUUGCCCAG | 240 |

TABLE 2-continued

| Sequence | SEQ ID NO: |
|---|---|
| CCACCAUCCAGUUUUGCCCA | 241 |
| CCCACCAUCCAGUUUUGCCC | 242 |
| UUGCUCCCAGCUUGGUAAGU | 243 |
| GCUUGCUCCCAGCUUGGUAA | 244 |
| AUCCUGCUUGCUCCCAGCUU | 245 |
| AAUCCUGCUUGCUCCCAGCU | 246 |
| CAAUCCUGCUUGCUCCCAGC | 247 |
| CCAAUCCUGCUUGCUCCCAG | 248 |
| AACCUUUCAGCUUCUCCAGG | 249 |
| UAACCUUUCAGCUUCUCCAG | 250 |
| UUAACCUUUCAGCUUCUCCA | 251 |
| ACUGCUGCUUAACCUUUCAG | 252 |
| UACUGCUGCUUAACCUUUCA | 253 |
| CUACUGCUGCUUAACCUUUC | 254 |
| CCUACUGCUGCUUAACCUUU | 255 |
| GCCUACUGCUGCUUAACCUU | 256 |
| CAGGACAGGAGUAGGCACCU | 257 |
| ACAGGACAGGAGUAGGCACC | 258 |
| GCACAGGACAGGAGUAGGCA | 259 |
| AUAGGCACAGGACAGGAGUA | 260 |
| GAUAGGCACAGGACAGGAGU | 261 |
| UGAUAGGCACAGGACAGGAG | 262 |
| ACCCUCUGCAAAUGUGAUAG | 263 |
| CUUACCCUCUGCAAAUGUGA | 264 |
| GUCUUACCCUCUGCAAAUGU | 265 |
| UGUCUUACCCUCUGCAAAUG | 266 |
| UUGUCUUACCCUCUGCAAAU | 267 |
| CUUGUCUUACCCUCUGCAAA | 268 |
| UCUUGUCUUACCCUCUGCAA | 269 |
| CAUUCUUGUCUUACCCUCUG | 270 |
| CCCAUUCUUGUCUUACCCUC | 271 |
| GAGCCUCAUCUUGUCCCUCC | 272 |
| UGAGCCUCAUCUUGUCCCUC | 273 |
| UGCGUUGGUGAUGGGAAGGA | 274 |
| GUGCGUUGGUGAUGGGAAGG | 275 |
| GGUGCGUUGGUGAUGGGAAG | 276 |
| GGGUGCGUUGGUGAUGGGAA | 277 |
| UGGGUGCGUUGGUGAUGGGA | 278 |

| Sequence | SEQ ID NO: |
|---|---|
| UCUCACAUGCCUGGACGCCU | 279 |
| CAAGGCAGGCUCUCACAUGC | 280 |
| UGCUGUUUCCUGGCAAGGCA | 281 |
| UUGUGCUGUUUCCUGGCAAG | 282 |
| CUUGUGCUGUUUCCUGGCAA | 283 |
| ACCACCAGGGAAUCUUACUG | 284 |
| UCCACCACCAGGGAAUCUUA | 285 |
| AUUUCCUUCCACCACCAGGG | 286 |
| UAUUUCCUUCCACCACCAGG | 287 |
| CCUAUUUCCUUCCACCACCA | 288 |
| AGUCCUCCUAUUUCCUUCCA | 289 |
| AGAGUCCUCCUAUUUCCUUC | 290 |
| AGCAGAGUCCUCCUAUUUCC | 291 |
| CAGCAGAGUCCUCCUAUUUC | 292 |
| AUUCAGCAGAGUCCUCCUAU | 293 |
| ACCAGGAUUCAGCAGAGUCC | 294 |
| GACCAGGAUUCAGCAGAGUC | 295 |
| GGACCAGGAUUCAGCAGAGU | 296 |
| CAGGACCAGGAUUCAGCAGA | 297 |
| CAGAAGCAGGACCAGGAUUC | 298 |
| ACAGAAGCAGGACCAGGAUU | 299 |
| AACAGAAGCAGGACCAGGAU | 300 |
| AGAACAGAAGCAGGACCAGG | 301 |
| GGGAGGGAUGAGAACAGAAG | 302 |
| CAGGCAACAUACACACUGCA | 303 |
| CCAGGCAACAUACACACUGC | 304 |
| ACCAGGCAACAUACACACUG | 305 |
| AGACCAGGCAACAUACACAC | 306 |
| GAGAGACCAGGCAACAUACA | 307 |
| CCAGAGAGACCAGGCAACAU | 308 |
| UUGUUUGGGUCACCUCUGCA | 309 |
| GUUGUUUGGGUCACCUCUGC | 310 |
| AGUUGUUUGGGUCACCUCUG | 311 |
| UGAGUUGUUUGGGUCACCUC | 312 |
| CUGAGUUGUUUGGGUCACCU | 313 |
| GACUGAGUUGUUUGGGUCAC | 314 |
| AAACAGGCAAGGAUAAGGCA | 315 |
| ACAUGGAAAAGCUGUCAUUG | 316 |

TABLE 2-continued

| Sequence | SEQ ID NO: |
|---|---|
| CCUUACAUGGAAAAGCUGUC | 317 |
| GCCUUACAUGGAAAAGCUGU | 318 |
| CUCCUGGAACCUAGCACCAU | 319 |
| CCUCCUGGAACCUAGCACCA | 320 |
| UCCUCCUGGAACCUAGCACC | 321 |
| AACCAUUAUGCCUCCAUGCA | 322 |
| UAACCAUUAUGCCUCCAUGC | 323 |
| CUAACCAUUAUGCCUCCAUG | 324 |
| CCUAACCAUUAUGCCUCCAU | 325 |
| CCCUAACCAUUAUGCCUCCA | 326 |
| ACUCCCUAACCAUUAUGCCU | 327 |
| GACUCCCUAACCAUUAUGCC | 328 |
| UGACUCCCUAACCAUUAUGC | 329 |
| AUGACUCCCUAACCAUUAUG | 330 |
| CAUGACUCCCUAACCAUUAU | 331 |
| GGGCCUCUUCAUGGUUGUGU | 332 |
| UGGUGCAGCCUGGUAAUGGG | 333 |
| CUGGUGCAGCCUGGUAAUGG | 334 |
| CCUGGUGCAGCCUGGUAAUG | 335 |
| AUCCUGGUGCAGCCUGGUAA | 336 |
| UAUCCUGGUGCAGCCUGGUA | 337 |
| GUAUCCUGGUGCAGCCUGGU | 338 |
| UGUAUCCUGGUGCAGCCUGG | 339 |
| UCUUGUAUCCUGGUGCAGCC | 340 |
| GUCUUGUAUCCUGGUGCAGC | 341 |
| UGUCUUGUAUCCUGGUGCAG | 342 |
| UUGUCUUGUAUCCUGGUGCA | 343 |
| CUUGUCUUGUAUCCUGGUGC | 344 |
| UCUUGUCUUGUAUCCUGGUG | 345 |
| UUCUUGUCUUGUAUCCUGGU | 346 |
| UUUCUUGUCUUGUAUCCUGG | 347 |
| CCUUUCUUGUCUUGUAUCCU | 348 |
| ACUCAUCCUUUCCUUUCUUG | 349 |
| CCUACUCAUCCUUUCCUUUC | 350 |
| CCCUACUCAUCCUUUCCUUU | 351 |
| UCCCUACUCAUCCUUUCCUU | 352 |
| GCUUCUUAGUAUGUCCCUAC | 353 |
| GCUGCUUCUUAGUAUGUCCC | 354 |
| GGCUGCUUCUUAGUAUGUCC | 355 |
| GGGCUGCUUCUUAGUAUGUC | 356 |
| AGGGCUGCUUCUUAGUAUGU | 357 |
| GAGAGGGCUGCUUCUUAGUA | 358 |
| UCCAAGAGGAGAGGGCUGCU | 359 |
| UUGACUUUUCCAAGAGGAGA | 360 |
| AGCUCUAUCCAUCUGCCAGG | 361 |
| GCUGUUACUUGAGCAGAGGC | 362 |
| GGCUGUUACUUGAGCAGAGG | 363 |
| UGGCUGUUACUUGAGCAGAG | 364 |
| CUGGCUGUUACUUGAGCAGA | 365 |
| UCUGGCUGUUACUUGAGCAG | 366 |
| CCUCAAGUUCUGGCUGUUAC | 367 |
| ACCUCAAGUUCUGGCUGUUA | 368 |
| CAACCUCAAGUUCUGGCUGU | 369 |
| GCAACCUCAAGUUCUGGCUG | 370 |
| AGCAACCUCAAGUUCUGGCU | 371 |
| CAAGCAACCUCAAGUUCUGG | 372 |
| CCAAGCAACCUCAAGUUCUG | 373 |
| CCCAAGCAACCUCAAGUUCU | 374 |
| ACUAAGACAGUGCUCCUGGU | 375 |
| CAAACUAAGACAGUGCUCCU | 376 |
| AGCUCUGCUUUGGAAGAACC | 377 |
| CCCUUAGCUCAAGCUCUGCU | 378 |
| GCCCUUAGCUCAAGCUCUGC | 379 |
| AAGCCCUUAGCUCAAGCUCU | 380 |
| CAAGCCCUUAGCUCAAGCUC | 381 |
| CCAAGCCCUUAGCUCAAGCU | 382 |
| CCCAAGCCCUUAGCUCAAGC | 383 |
| GUACCCAAGCCCUUAGCUCA | 384 |
| UGUACCCAAGCCCUUAGCUC | 385 |
| CUGUACCCAAGCCCUUAGCU | 386 |
| CCUGUACCCAAGCCCUUAGC | 387 |
| ACCUGUACCCAAGCCCUUAG | 388 |
| UCACCUGUACCCAAGCCCUU | 389 |
| AUCACCUGUACCCAAGCCCU | 390 |
| GGAUCACCUGUACCCAAGCC | 391 |
| CUCAAGAAUACAGGAUCACC | 392 |

TABLE 2-continued

| Sequence | SEQ ID NO: |
|---|---|
| CUUAGCUCAAGAAUACAGGA | 393 |
| CCUUAGCUCAAGAAUACAGG | 394 |
| GCCCUUAGCUCAAGAAUACA | 395 |
| AGCCCUUAGCUCAAGAAUAC | 396 |
| AAGCCCUUAGCUCAAGAAUA | 397 |
| CAAGCCCUUAGCUCAAGAAU | 398 |
| CCAAGCCCUUAGCUCAAGAA | 399 |
| CCCAAGCCCUUAGCUCAAGA | 400 |
| GUACCCAAGCCCUUAGCUCA | 401 |
| UGUACCCAAGCCCUUAGCUC | 402 |
| CUGUACCCAAGCCCUUAGCU | 403 |
| CCUGUACCCAAGCCCUUAGC | 404 |
| ACCUGUACCCAAGCCCUUAG | 405 |
| UCACCUGUACCCAAGCCCUU | 406 |
| AUCACCUGUACCCAAGCCCU | 407 |
| GGAUCACCUGUACCCAAGCC | 408 |
| UAACCUCCCAAAUACAGGAU | 409 |
| UACCUUAUGCCCUCACUUCC | 410 |
| UUACCUUAUGCCCUCACUUC | 411 |
| UUUACCUUAUGCCCUCACUU | 412 |
| UUUUACCUUAUGCCCUCACU | 413 |
| UUGUUUUACCUUAUGCCCUC | 414 |
| CUUGUUUUACCUUAUGCCCU | 415 |
| UUAAUGGCUUUCCUCUCUCU | 416 |
| ACUCUUAAUGGCUUUCCUCU | 417 |
| UACUCUUAAUGGCUUUCCUC | 418 |
| CAUACUCUUAAUGGCUUUCC | 419 |
| GAAGGGACUUAACAUACUCU | 420 |
| UGAAGGGACUUAACAUACUC | 421 |
| ACUGAAGGGACUUAACAUAC | 422 |
| CUACUGAAGGGACUUAACAU | 423 |
| GCCUACUGAAGGGACUUAAC | 424 |
| GGCCUACUGAAGGGACUUAA | 425 |
| UUCUCAGAGGUUCCCAAGGC | 426 |
| UUUUCUCAGAGGUUCCCAAG | 427 |
| ACUUUUCUCAGAGGUUCCCA | 428 |
| UACUUUUCUCAGAGGUUCCC | 429 |
| GGGCAAUCUAUACUUUUCUC | 430 |

TABLE 2-continued

| Sequence | SEQ ID NO: |
|---|---|
| UGUCUUGGGCAAUCUAUACU | 431 |
| CCAGUCUUUUGUCUUGGGCA | 432 |
| GCCAGUCUUUUGUCUUGGGC | 433 |
| UGCCAGUCUUUUGUCUUGGG | 434 |
| CUGCCAGUCUUUUGUCUUGG | 435 |
| UCACCCUGCCAGUCUUUUGU | 436 |
| AUCACCCUGCCAGUCUUUUG | 437 |
| GCCCACUCAUUAAGUACAUU | 438 |
| CUGUAGCCCACUCAUUAAGU | 439 |
| CGCUGUAGCCCACUCAUUAA | 440 |
| ACGCUGUAGCCCACUCAUUA | 441 |
| UACGCUGUAGCCCACUCAUU | 442 |
| AUACGCUGUAGCCCACUCAU | 443 |
| GAUACGCUGUAGCCCACUCA | 444 |
| GGAUACGCUGUAGCCCACUC | 445 |
| AGGAUACGCUGUAGCCCACU | 446 |
| GAGGAUACGCUGUAGCCCAC | 447 |
| UGAGGAUACGCUGUAGCCCA | 448 |
| GUGAGGAUACGCUGUAGCCC | 449 |
| UGUGAGGAUACGCUGUAGCC | 450 |
| CUGUUGUGAGGAUACGCUGU | 451 |
| UCUGUUGUGAGGAUACGCUG | 452 |
| GUCUGUUGUGAGGAUACGCU | 453 |
| UGUCUGUUGUGAGGAUACGC | 454 |
| ACUGUCUGUUGUGAGGAUAC | 455 |
| CACUGUCUGUUGUGAGGAUA | 456 |
| CAACUCUCUCUCACUGUCUG | 457 |
| AACAACUCUCUCUCACUGUC | 458 |
| AGAACAACUCUCUCUCACUG | 459 |
| GUAGAACAACUCUCUCUCAC | 460 |
| GGUAGAACAACUCUCUCUCA | 461 |
| CAGGUAGAACAACUCUCUCU | 462 |
| CCAGGUAGAACAACUCUCUC | 463 |
| ACCCAGGUAGAACAACUCUC | 464 |
| UAUACCCAGGUAGAACAACU | 465 |
| AUAUACCCAGGUAGAACAAC | 466 |
| GGAUAUACCCAGGUAGAACA | 467 |
| GUUUUGGAUAUACCCAGGUA | 468 |

TABLE 2-continued

| Sequence | SEQ ID NO: |
|---|---|
| CCUUGUUUUGGAUAUACCCA | 469 |
| CCCUUGUUUUGGAUAUACCC | 470 |
| CCUCGUAAACUCCAUACCCU | 471 |
| CCCUCGUAAACUCCAUACCC | 472 |
| ACCCUCGUAAACUCCAUACC | 473 |
| AACCCUCGUAAACUCCAUAC | 474 |
| GAACCCUCGUAAACUCCAUA | 475 |
| UGAACCCUCGUAAACUCCAU | 476 |
| UUGAACCCUCGUAAACUCCA | 477 |
| CUUGAACCCUCGUAAACUCC | 478 |
| CCUUGAACCCUCGUAAACUC | 479 |
| ACCUUGAACCCUCGUAAACU | 480 |
| UACCUUGAACCCUCGUAAAC | 481 |
| AUACCUUGAACCCUCGUAAA | 482 |
| AAUACCUUGAACCCUCGUAA | 483 |
| AAAUACCUUGAACCCUCGUA | 484 |
| CAAAUACCUUGAACCCUCGU | 485 |
| CCAAAUACCUUGAACCCUCG | 486 |
| ACCAAAUACCUUGAACCCUC | 487 |
| AACCAAAUACCUUGAACCCU | 488 |
| GAACCAAAUACCUUGAACCC | 489 |
| UGAACCAAAUACCUUGAACC | 490 |
| CCCUGAACCAAAUACCUUGA | 491 |
| GGCCCUGAACCAAAUACCUU | 492 |
| UGGCCCUGAACCAAAUACCU | 493 |
| UAUUCAGGUUGUUGCCCAAA | 494 |
| GGUAUUCAGGUUGUUGCCCA | 495 |
| AGGUAUUCAGGUUGUUGCCC | 496 |
| AAGGUAUUCAGGUUGUUGCC | 497 |
| AAAGGUAUUCAGGUUGUUGC | 498 |
| UAACUUGAUUGCCCUGUGAC | 499 |
| GUAACUUGAUUGCCCUGUGA | 500 |
| AGUAACUUGAUUGCCCUGUG | 501 |
| CAGAGUAACUUGAUUGCCCU | 502 |
| ACAGAGUAACUUGAUUGCCC | 503 |
| CACAGAGUAACUUGAUUGCC | 504 |
| UGUCCUGACAAAGAAACACA | 505 |
| CAAUCCCUGCUUUCCUGCCA | 506 |
| ACAAUCCCUGCUUUCCUGCC | 507 |
| AACACAAUCCCUGCUUUCCU | 508 |
| GAACACAAUCCCUGCUUUCC | 509 |
| AAUGAACACAAUCCCUGCUU | 510 |
| AAAUGAACACAAUCCCUGCU | 511 |
| GUGAAACCCUCAAAUGAACA | 512 |
| AGUGAAACCCUCAAAUGAAC | 513 |
| CAGUGAAACCCUCAAAUGAA | 514 |
| ACAGUGAAACCCUCAAAUGA | 515 |
| GCAUGGAAGCUGAGACUCUC | 516 |
| UUGCAUGGAAGCUGAGACUC | 517 |
| CAGUUGCAUGGAAGCUGAGA | 518 |
| ACAGUUGCAUGGAAGCUGAG | 519 |
| GACAGUUGCAUGGAAGCUGA | 520 |
| AUGGACAGUUGCAUGGAAGC | 521 |
| GUGAUGGACAGUUGCAUGGA | 522 |
| CGUGAUGGACAGUUGCAUGG | 523 |
| CCGUGAUGGACAGUUGCAUG | 524 |
| GCCGUGAUGGACAGUUGCAU | 525 |
| AGCCGUGAUGGACAGUUGCA | 526 |
| CAGCCGUGAUGGACAGUUGC | 527 |
| GCAGCCGUGAUGGACAGUUG | 528 |
| UGCAGCCGUGAUGGACAGUU | 529 |
| UUGCAGCCGUGAUGGACAGU | 530 |
| GUUGCAGCCGUGAUGGACAG | 531 |
| CAGUUGCAGCCGUGAUGGAC | 532 |
| UCAGUUGCAGCCGUGAUGGA | 533 |
| UUCAGUUGCAGCCGUGAUGG | 534 |
| UUUCAGUUGCAGCCGUGAUG | 535 |
| AUUUCAGUUGCAGCCGUGAU | 536 |
| GAUUUCAGUUGCAGCCGUGA | 537 |
| UGAUUUCAGUUGCAGCCGUG | 538 |
| CUCUGAUUUCAGUUGCAGCC | 539 |
| UUAGCUUCUGGUGCGCUGUG | 540 |
| UUUAGCUUCUGGUGCGCUGU | 541 |
| CUUUAGCUUCUGGUGCGCUG | 542 |
| GACUUUAGCUUCUGGUGCGC | 543 |
| AGACUUUAGCUUCUGGUGCG | 544 |

TABLE 2-continued

| Sequence | SEQ ID NO: |
|---|---|
| AAGACUUUAGCUUCUGGUGC | 545 |
| UCAAGACUUUAGCUUCUGGU | 546 |
| AUCAAGACUUUAGCUUCUGG | 547 |
| GCAUCAAGACUUUAGCUUCU | 548 |
| AUGGCAUCAAGACUUUAGCU | 549 |
| GAUGGCAUCAAGACUUUAGC | 550 |
| AGGGAUGUCCUUUGAUGGCA | 551 |
| GCAGGGAUGUCCUUUGAUGG | 552 |
| GGCAGGGAUGUCCUUUGAUG | 553 |
| CGUGACAGAGAUGUGAAUGG | 554 |
| GGACGUGACAGAGAUGUGAA | 555 |
| UGGACGUGACAGAGAUGUGA | 556 |
| GUGGACGUGACAGAGAUGUG | 557 |
| AGUGGACGUGACAGAGAUGU | 558 |
| UAGUGGACGUGACAGAGAUG | 559 |
| UUAGUGGACGUGACAGAGAU | 560 |
| AUUAGUGGACGUGACAGAGA | 561 |
| GAUUAGUGGACGUGACAGAG | 562 |
| CGAUUAGUGGACGUGACAGA | 563 |
| CCGAUUAGUGGACGUGACAG | 564 |
| UGCCGAUUAGUGGACGUGAC | 565 |
| UUGCCGAUUAGUGGACGUGA | 566 |
| UUUGCCGAUUAGUGGACGUG | 567 |
| UUUUGCCGAUUAGUGGACGU | 568 |
| CUUUUGCCGAUUAGUGGACG | 569 |
| CCUUUUGCCGAUUAGUGGAC | 570 |
| UCCUUUUGCCGAUUAGUGGA | 571 |
| CUCCUUUUGCCGAUUAGUGG | 572 |
| UCUCCUUUUGCCGAUUAGUG | 573 |
| UUCUCCUUUUGCCGAUUAGU | 574 |
| UUUCUCCUUUUGCCGAUUAG | 575 |
| AGGUCAUCUUCUCUCACUUU | 576 |
| UUAGGUCAUCUUCUCUCACU | 577 |
| CUUAGGUCAUCUUCUCUCAC | 578 |
| ACACUUAGGUCAUCUUCUCU | 579 |
| CACACUUAGGUCAUCUUCUC | 580 |
| UCACACUUAGGUCAUCUUCU | 581 |
| GUCACACUUAGGUCAUCUUC | 582 |

TABLE 2-continued

| Sequence | SEQ ID NO: |
|---|---|
| AGUCACACUUAGGUCAUCUU | 583 |
| CAGUCACACUUAGGUCAUCU | 584 |
| GCAGUCACACUUAGGUCAUC | 585 |
| UGCAGUCACACUUAGGUCAU | 586 |
| AUUUUCCAGAGCUGCCUGCU | 587 |
| CUCACUGCUCUGGCUUCAUU | 588 |
| GCUCACUGCUCUGGCUUCAU | 589 |
| UUACCUGCUCUUUCCUUCCU | 590 |
| UGCUUACCUGCUCUUUCCUU | 591 |
| UUCCUGCUUACCUGCUCUUU | 592 |
| CUUCCUGCUUACCUGCUCUU | 593 |
| ACUGGCCUUCCUGCUUACCU | 594 |
| GACACUGGCCUUCCUGCUUA | 595 |
| CAUUAGGGUCCUGUCUGGGA | 596 |
| UCAUUAGGGUCCUGUCUGGG | 597 |
| AUCAUUAGGGUCCUGUCUGG | 598 |
| GAUCAUUAGGGUCCUGUCUG | 599 |
| GGAUCAUUAGGGUCCUGUCU | 600 |
| AUUCAGGAUCAUUAGGGUCC | 601 |
| GAUUCAGGAUCAUUAGGGUC | 602 |
| GGAUUCAGGAUCAUUAGGGU | 603 |
| AUGGAUUCAGGAUCAUUAGG | 604 |
| GAUACAUGGAUUCAGGAUCA | 605 |
| UGAUACAUGGAUUCAGGAUC | 606 |
| AUGGCAGGGCUUUGGAAAAU | 607 |
| CAUGGCAGGGCUUUGGAAAA | 608 |
| GCAUGGCAGGGCUUUGGAAA | 609 |
| CAGCAUGGCAGGGCUUUGGA | 610 |
| GAAGUGGGAUGGCAGCAUGG | 611 |
| GGAAGUGGGAUGGCAGCAUG | 612 |
| GGGAAGUGGGAUGGCAGCAU | 613 |
| UGGAGAAGCCAUAAGCUGCA | 614 |
| CUGGAGAAGCCAUAAGCUGC | 615 |
| ACUGGAGAAGCCAUAAGCUG | 616 |
| UACUGGAGAAGCCAUAAGCU | 617 |
| CUACUGGAGAAGCCAUAAGC | 618 |
| CCUACUGGAGAAGCCAUAAG | 619 |
| ACCUACUGGAGAAGCCAUAA | 620 |

TABLE 2-continued

| Sequence | SEQ ID NO: |
|---|---|
| CACCUACUGGAGAAGCCAUA | 621 |
| CCACCUACUGGAGAAGCCAU | 622 |
| GCCACCUACUGGAGAAGCCA | 623 |
| CUGCCACCUACUGGAGAAGC | 624 |
| GCUGCCACCUACUGGAGAAG | 625 |
| UGUGUGCUGCCACCUACU | 626 |
| CUGUGUGCUGCCACCUAC | 627 |
| UUAUGAGUGGCUCUGUGUGU | 628 |
| UUUAUGAGUGGCUCUGUGUG | 629 |
| AGUUUAUGAGUGGCUCUGUG | 630 |
| CAGUUUAUGAGUGGCUCUGU | 631 |
| GUUUCUGGCUCUCAGGCUCU | 632 |
| GGUUUCUGGCUCUCAGGCUC | 633 |
| CGGUUUCUGGCUCUCAGGCU | 634 |
| GGACGGUUUCUGGCUCUCAG | 635 |
| GGGACGGUUUCUGGCUCUCA | 636 |
| UGAAAUGUGACUUCUGGUGU | 637 |
| GGGAACCAUGUAAAAGGAUG | 638 |
| GUGAGGGUAGAUGGGAACCA | 639 |
| UUGUGAGGGUAGAUGGGAAC | 640 |
| GUUGUGAGGGUAGAUGGGAA | 641 |
| UGUUGUGAGGGUAGAUGGGA | 642 |
| AUGUGUGUCUUUGGUGAUGA | 643 |
| GGAGCUUGUAUGUGUGUCUU | 644 |
| UUGGAGCUUGUAUGUGUGUC | 645 |
| AUUGGAGCUUGUAUGUGUGU | 646 |
| CAUUGGAGCUUGUAUGUGUG | 647 |
| CCAUUGGAGCUUGUAUGUGU | 648 |
| GCCAUUGGAGCUUGUAUGUG | 649 |
| AGCCAUUGGAGCUUGUAUGU | 650 |
| CUGGAGGAAGAAUUGCCUGG | 651 |
| GUCCUGGAGGAAGAAUUGCC | 652 |
| GCCAGUAAGAAGGGCAAAGU | 653 |
| GGCCAGUAAGAAGGGCAAAG | 654 |
| GGAAUGAGUCAAGCCUGGAC | 655 |
| GGGAAUGAGUCAAGCCUGGA | 656 |
| GUGGGAAUGAGUCAAGCCUG | 657 |
| AAGGUGGGAAUGAGUCAAGC | 658 |

| Sequence | SEQ ID NO: |
|---|---|
| UCUCAGCCCAGGACAAGGUG | 659 |
| AUCUCAGCCCAGGACAAGGU | 660 |
| GCUGGGUGGUUCUCUCCUGU | 661 |
| UUCUGGGCUGGGUGGUUCUC | 662 |
| GAACUUCUGGGCUGGGUGGU | 663 |
| CGGAGAGUUCCUUCCCUGGA | 664 |
| ACCGGAGAGUUCCUUCCCUG | 665 |
| GACCGGAGAGUUCCUUCCCU | 666 |
| UGGACCGGAGAGUUCCUUCC | 667 |
| GUGGACCGGAGAGUUCCUUC | 668 |
| GGUGGACCGGAGAGUUCCUU | 669 |
| UGGUGGACCGGAGAGUUCCU | 670 |
| AUGGUGGACCGGAGAGUUCC | 671 |
| CAUGGUGGACCGGAGAGUUC | 672 |
| GAGCUGAGAGGUACUCCAUG | 673 |
| AGAGCUGAGAGGUACUCCAU | 674 |
| CAGAGCUGAGAGGUACUCCA | 675 |
| UUCAGAGCUGAGAGGUACUC | 676 |
| GGUUCAGAGCUGAGAGGUAC | 677 |
| GGGUUCAGAGCUGAGAGGUA | 678 |
| CACCUGAGUAAGUCACUGGG | 679 |
| UCACCUGAGUAAGUCACUGG | 680 |
| GUCACCUGAGUAAGUCACUG | 681 |
| AGUCACCUGAGUAAGUCACU | 682 |
| CAGUCACCUGAGUAAGUCAC | 683 |
| GCAGUCACCUGAGUAAGUCA | 684 |
| UUAGCAGUCACCUGAGUAAG | 685 |
| GUUAGCAGUCACCUGAGUAA | 686 |
| GGUUAGCAGUCACCUGAGUA | 687 |
| GGGUUAGCAGUCACCUGAGU | 688 |
| AGGGUUAGCAGUCACCUGAG | 689 |
| GAGGGUUAGCAGUCACCUGA | 690 |
| GGAGGGUUAGCAGUCACCUG | 691 |
| CGGAGGGUUAGCAGUCACCU | 692 |
| AGCGGAGGGUUAGCAGUCAC | 693 |
| GAGCGGAGGGUUAGCAGUCA | 694 |
| AGAGCGGAGGGUUAGCAGUC | 695 |
| UAGAGCGGAGGGUUAGCAGU | 696 |

TABLE 2-continued

| Sequence | SEQ ID NO: |
|---|---|
| GUAGAGCGGAGGGUUAGCAG | 697 |
| GGUAGAGCGGAGGGUUAGCA | 698 |
| AGGGUAGAGCGGAGGGUUAG | 699 |
| GAGGGUAGAGCGGAGGGUUA | 700 |
| AUUGUUGCCCUGCCUAUAUC | 701 |
| AGUAUUGUUGCCCUGCCUAU | 702 |
| GAGUAUUGUUGCCCUGCCUA | 703 |
| GGAGUAUUGUUGCCCUGCCU | 704 |
| UGGAGUAUUGUUGCCCUGCC | 705 |
| GUGGAGUAUUGUUGCCCUGC | 706 |
| AGUGGAGUAUUGUUGCCCUG | 707 |
| GAGUGGAGUAUUGUUGCCCU | 708 |
| UGAGUGGAGUAUUGUUGCCC | 709 |
| CUGAGUGGAGUAUUGUUGCC | 710 |
| GCUGAGUGGAGUAUUGUUGC | 711 |
| GGCUGAGUGGAGUAUUGUUG | 712 |
| GGGCUGAGUGGAGUAUUGUU | 713 |
| GGUACUGGUUAGUCUCCUAG | 714 |
| GGGUACUGGUUAGUCUCCUA | 715 |
| UUGACAAGCCCACUGUGGAG | 716 |
| UGGCUCAGGAGCUUGACAAG | 717 |
| GGUGGCUCAGGAGCUUGACA | 718 |
| UAGGGAUGAGGGAGAGACCA | 719 |
| UCGAUUAGGGAUGAGGGAGA | 720 |
| UAGAGGGCUAGGGAGGGAGA | 721 |
| GUAGAGUGGCUAGAGGGCUA | 722 |
| GGUAGAGUGGCUAGAGGGCU | 723 |
| UGAGGGUAGAGUGGCUAGAG | 724 |
| GAUGAGGGUAGAGUGGCUAG | 725 |
| CAUGAUGAGGGUAGAGUGGC | 726 |
| GCAUGAUGAGGGUAGAGUGG | 727 |
| GGGCAUGAUGAGGGUAGAGU | 728 |
| GGUAGUUGAAGAAAAGUC | 729 |
| CCAAACUCCGAGCUUAUAUU | 730 |
| UCCAAACUCCGAGCUUAUAU | 731 |
| GUCCAAACUCCGAGCUUAUA | 732 |
| CGUCCAAACUCCGAGCUUAU | 733 |
| CCGUCCAAACUCCGAGCUUA | 734 |

TABLE 2-continued

| Sequence | SEQ ID NO: |
|---|---|
| UCCGUCCAAACUCCGAGCUU | 735 |
| CUCCGUCCAAACUCCGAGCU | 736 |
| ACCCUCCGUCCAAACUCCGA | 737 |
| AGACCCUCCGUCCAAACUCC | 738 |
| CAGACCCUCCGUCCAAACUC | 739 |
| UCCAGACCCUCCGUCCAAAC | 740 |
| GUCCAGACCCUCCGUCCAAA | 741 |
| AGACACGGAAAGGUCGCUGG | 742 |
| CAGACACGGAAAGGUCGCUG | 743 |
| ACAGACACGGAAAGGUCGCU | 744 |
| CACAGACACGGAAAGGUCGC | 745 |
| UCACAGACACGGAAAGGUCG | 746 |
| AUCACAGACACGGAAAGGUC | 747 |
| GAUCACAGACACGGAAAGGU | 748 |
| UUGGCCUACUUACUUUGGCU | 749 |
| CUUGGCCUACUUACUUUGGC | 750 |
| ACUUGGCCUACUUACUUUGG | 751 |
| GAGGAACUUGGCCUACUUAC | 752 |
| CGAGGAACUUGGCCUACUUA | 753 |
| CCGAGGAACUUGGCCUACUU | 754 |
| ACCGAGGAACUUGGCCUACU | 755 |
| AACCGAGGAACUUGGCCUAC | 756 |
| GAACCGAGGAACUUGGCCUA | 757 |
| GGAACCGAGGAACUUGGCCU | 758 |
| AGGAACCGAGGAACUUGGCC | 759 |
| UAGGAACCGAGGAACUUGGC | 760 |
| AUAGGAACCGAGGAACUUGG | 761 |
| UAUAGGAACCGAGGAACUUG | 762 |
| AUCACAAGUUGCCACUGUUG | 763 |
| CAUCACAAGUUGCCACUGUU | 764 |
| AUCAUCACAAGUUGCCACUG | 765 |
| CAUCAUCACAAGUUGCCACU | 766 |
| CUGCUCCAUCAUCACAAGUU | 767 |
| UCUGCUCCAUCAUCACAAGU | 768 |
| CCCUCUGCUCCAUCAUCACA | 769 |
| UCAGCCCUCUGCUCCAUCAU | 770 |
| UGACUUCAGCCCUCUGCUCC | 771 |
| GUGACUUCAGCCCUCUGCUC | 772 |

TABLE 2-continued

| Sequence | SEQ ID NO: |
|---|---|
| UGUGACUUCAGCCCUCUGCU | 773 |
| GUGUGACUUCAGCCCUCUGC | 774 |
| UGUGUGACUUCAGCCCUCUG | 775 |
| GCCCACUCCGCUGCUUUUAG | 776 |
| GGCCCACUCCGCUGCUUUUA | 777 |
| AGGCCCACUCCGCUGCUUUU | 778 |
| UAGGCCCACUCCGCUGCUUU | 779 |
| UUAGGCCCACUCCGCUGCUU | 780 |
| AUUAGGCCCACUCCGCUGCU | 781 |
| UCAUUAGGCCCACUCCGCUG | 782 |
| CUCAUUAGGCCCACUCCGCU | 783 |
| AGCUCAUUAGGCCCACUCCG | 784 |
| CUCCCAUAGAAAAGCUCACU | 785 |
| GCUCCCAUAGAAAAGCUCAC | 786 |
| UGCUCCCAUAGAAAAGCUCA | 787 |
| CUGCUCCCAUAGAAAAGCUC | 788 |
| CCUGCUCCCAUAGAAAAGCU | 789 |
| UCCCUAUCUCCUGCUAACCC | 790 |
| CCUCGAACUCUCCCUAUCUC | 791 |
| CCCUCGAACUCUCCCUAUCU | 792 |
| UCCCUCGAACUCUCCCUAUC | 793 |
| GUCCCUCGAACUCUCCCUAU | 794 |
| CUUUCCAUACUAGCUUCUGA | 795 |
| CCUUUCCAUACUAGCUUCUG | 796 |
| ACCUUUCCAUACUAGCUUCU | 797 |
| CACACAAAUCACCUUUCCAU | 798 |
| GUCACACAAAUCACCUUUCC | 799 |
| UGUCACACAAAUCACCUUUC | 800 |
| UUUGACAGGCAGGAAGUGGC | 801 |
| GGUUUGACAGGCAGGAAGUG | 802 |
| AGGUUUGACAGGCAGGAAGU | 803 |
| AAGGUUUGACAGGCAGGAAG | 804 |
| AACUUCCCAAGGUUUGACAG | 805 |
| CAACUUCCCAAGGUUUGACA | 806 |
| GAACAACUUCCCAAGGUUUG | 807 |
| UGAACAACUUCCCAAGGUUU | 808 |
| GUAGGUUGAACAACUUCCCA | 809 |
| GGUAGGUUGAACAACUUCCC | 810 |
| UGGUAGGUUGAACAACUUCC | 811 |
| GGUUUUGGUAGGUUGAACAA | 812 |
| UGAGGUUUUGGUAGGUUGAA | 813 |
| CUGAGGUUUUGGUAGGUUGA | 814 |
| CCUACAUUAUCCUCUUACUC | 815 |
| GGACUUUACCUACAUUAUCC | 816 |
| GUAUGAGGACUUUACCUACA | 817 |
| GCCAGGUAUGAGGACUUUAC | 818 |
| UGCCAGGUAUGAGGACUUUA | 819 |
| GUGCCAGGUAUGAGGACUUU | 820 |
| CUGUGCCAGGUAUGAGGACU | 821 |
| UCUGUGCCAGGUAUGAGGAC | 822 |
| CCUCAAGAGUUCUCCAGAAG | 823 |
| CCCUCAAGAGUUCUCCAGAA | 824 |
| ACCCUCAAGAGUUCUCCAGA | 825 |
| ACACCCUCAAGAGUUCUCCA | 826 |
| CACACCCUCAAGAGUUCUCC | 827 |
| CCACACCCUCAAGAGUUCUC | 828 |
| CCCACACCCUCAAGAGUUCU | 829 |
| UUCCCACACCCUCAAGAGUU | 830 |
| CAAUGCUGCACCUCACUUCC | 831 |
| UACAAUGCUGCACCUCACUU | 832 |
| CUACAAUGCUGCACCUCACU | 833 |
| UCUACAAUGCUGCACCUCAC | 834 |
| AUCUACAAUGCUGCACCUCA | 835 |
| UAUCUACAAUGCUGCACCUC | 836 |
| CUUAUCUACAAUGCUGCACC | 837 |
| GUCUUAUCUACAAUGCUGCA | 838 |
| UGUCUUAUCUACAAUGCUGC | 839 |
| CUGUCUUAUCUACAAUGCUG | 840 |
| CACCCUUCUGUCUUAUCUAC | 841 |
| UCCACCCUUCUGUCUUAUCU | 842 |
| GUCCACCCUUCUGUCUUAUC | 843 |
| AGUCCACCCUUCUGUCUUAU | 844 |
| AAGUCCACCCUUCUGUCUUA | 845 |
| GAAAGCAAGCCAGGUUCUCA | 846 |
| GGAAAGCAAGCCAGGUUCUC | 847 |
| GGAAUUGGAAAGCAAGCCAG | 848 |

TABLE 2-continued

| Sequence | SEQ ID NO: |
|---|---|
| ACCAUGUCAUUGGCAUCUCC | 849 |
| UACCAUGUCAUUGGCAUCUC | 850 |
| CCUACCAUGUCAUUGGCAUC | 851 |
| UCCUACCAUGUCAUUGGCAU | 852 |
| CUCCUACCAUGUCAUUGGCA | 853 |
| GCUCCUACCAUGUCAUUGGC | 854 |
| UGCUCCUACCAUGUCAUUGG | 855 |
| UCUUUGCUCCUACCAUGUCA | 856 |
| CCUCUUUGCUCCUACCAUGU | 857 |
| UUCCUCUUUGCUCCUACCAU | 858 |
| UCUCCGUGUUCUUCAGUUUU | 859 |
| CUCUCCGUGUUCUUCAGUUU | 860 |
| AGCUCUCCGUGUUCUUCAGU | 861 |
| UGCAGCUCUCCGUGUUCUUC | 862 |
| GGUUGCAGCUCUCCGUGUUC | 863 |
| AGGUUGCAGCUCUCCGUGUU | 864 |
| AAAGGUUGCAGCUCUCCGUG | 865 |
| UAAAGGUUGCAGCUCUCCGU | 866 |
| CUAAAGGUUGCAGCUCUCCG | 867 |
| CCUAAAGGUUGCAGCUCUCC | 868 |
| UCCUAAAGGUUGCAGCUCUC | 869 |
| CUCCUAAAGGUUGCAGCUCU | 870 |
| CCUCCUAAAGGUUGCAGCUC | 871 |
| GCACUUUGAUACCUCCUAAA | 872 |
| GGCACUUUGAUACCUCCUAA | 873 |
| GAUGUCCCACUUUGACUUUC | 874 |
| UCGAUGUCCCACUUUGACUU | 875 |
| GUCGAUGUCCCACUUUGACU | 876 |
| GGUCGAUGUCCCACUUUGAC | 877 |
| UGGUCGAUGUCCCACUUUGA | 878 |
| UUGGUCGAUGUCCCACUUUG | 879 |
| AUUGGUCGAUGUCCCACUUU | 880 |
| CAUUGGUCGAUGUCCCACUU | 881 |
| AACAUCCAUCAGUUGGCUCU | 882 |
| CUGCCCAACAUCCAUCAGUU | 883 |
| AGCUGCCCAACAUCCAUCAG | 884 |
| UAGCUGCCCAACAUCCAUCA | 885 |
| UUAGCUGCCCAACAUCCAUC | 886 |
| UUUAGCUGCCCAACAUCCAU | 887 |
| CUUUAGCUGCCCAACAUCCA | 888 |
| CCUCUUUAGCUGCCCAACAU | 889 |
| CCCUCUUUAGCUGCCCAACA | 890 |
| UCCCUCUUUAGCUGCCCAAC | 891 |
| UUCCCUCUUUAGCUGCCCAA | 892 |
| CCUUCCCUCUUUAGCUGCCC | 893 |
| CCCUUCCCUCUUUAGCUGCC | 894 |
| GCAGGUCUUAUCCCAUGCCC | 895 |
| GGGCAGGUCUUAUCCCAUGC | 896 |
| AGGGCAGGUCUUAUCCCAUG | 897 |
| AAGGGCAGGUCUUAUCCCAU | 898 |
| GAAGGGCAGGUCUUAUCCCA | 899 |
| AGAAGGGCAGGUCUUAUCCC | 900 |
| CCAAUGGCAAGAAGCAAGAA | 901 |
| CCCAAUGGCAAGAAGCAAGA | 902 |
| GCCCAAUGGCAAGAAGCAAG | 903 |
| UCCAAUGCCUGCCCAAUGGC | 904 |
| CUCCAAUGCCUGCCCAAUGG | 905 |
| UCUCCAAUGCCUGCCCAAUG | 906 |
| GGUCUCCAAUGCCUGCCCAA | 907 |
| UAGGGUCUCCAAUGCCUGCC | 908 |
| GUAGGGUCUCCAAUGCCUGC | 909 |
| AGUAGGGUCUCCAAUGCCUG | 910 |
| CAGUAGGGUCUCCAAUGCCU | 911 |
| GCAGUAGGGUCUCCAAUGCC | 912 |
| AGCAGUAGGGUCUCCAAUGC | 913 |
| CAGCAGUAGGGUCUCCAAUG | 914 |
| UCAGCAGUAGGGUCUCCAAU | 915 |
| AUUCAGCAGUAGGGUCUCCA | 916 |
| CAUUCAGCAGUAGGGUCUCC | 917 |
| CCAUUCAGCAGUAGGGUCUC | 918 |
| UCCAUUCAGCAGUAGGGUCU | 919 |
| ACUCCAUUCAGCAGUAGGGU | 920 |
| CACUCCAUUCAGCAGUAGGG | 921 |
| GCACUCCAUUCAGCAGUAGG | 922 |
| AGCACUCCAUUCAGCAGUAG | 923 |
| UAGCACUCCAUUCAGCAGUA | 924 |

TABLE 2-continued

| Sequence | SEQ ID NO: |
|---|---|
| GUUAGCACUCCAUUCAGCAG | 925 |
| GGUUAGCACUCCAUUCAGCA | 926 |
| GGGUUAGCACUCCAUUCAGC | 927 |
| CAGGGUUAGCACUCCAUUCA | 928 |
| CCAGGGUUAGCACUCCAUUC | 929 |
| ACCAGGGUUAGCACUCCAUU | 930 |
| CACCAGGGUUAGCACUCCAU | 931 |
| GCACCAGGGUUAGCACUCCA | 932 |
| AGCACCAGGGUUAGCACUCC | 933 |
| UAGCACCAGGGUUAGCACUC | 934 |
| CUAGCACCAGGGUUAGCACU | 935 |
| UCUAGCACCAGGGUUAGCAC | 936 |
| CUCUAGCACCAGGGUUAGCA | 937 |
| CCUCUAGCACCAGGGUUAGC | 938 |
| UCCUCUAGCACCAGGGUUAG | 939 |
| CUCCUCUAGCACCAGGGUUA | 940 |
| CCUCCUCUAGCACCAGGGUU | 941 |
| UCCUCCUCUAGCACCAGGGU | 942 |
| GUUCCAUCCUCCUCUAGCAC | 943 |
| AAGUCCUCACUGUCCACUGC | 944 |
| GAAGUCCUCACUGUCCACUG | 945 |
| AGAAGUCCUCACUGUCCACU | 946 |
| AAGAAGUCCUCACUGUCCAC | 947 |
| GAAGAAGUCCUCACUGUCCA | 948 |
| GGAAGAAGUCCUCACUGUCC | 949 |
| UGGAAGAAGUCCUCACUGUC | 950 |
| CUGGAAGAAGUCCUCACUGU | 951 |
| AGCUGGAAGAAGUCCUCACU | 952 |
| ACUGCAACACCAUCAGGCAC | 953 |
| GACUGCAACACCAUCAGGCA | 954 |
| AGACUGCAACACCAUCAGGC | 955 |
| CAGACUGCAACACCAUCAGG | 956 |
| CCAGACUGCAACACCAUCAG | 957 |
| GACCAGACUGCAACACCAUC | 958 |
| CUCUGACCAGACUGCAACAC | 959 |
| AGCUCUGACCAGACUGCAAC | 960 |
| CCAGCUCUGACCAGACUGCA | 961 |
| UGUAGGGCUCCAGCUCUGAC | 962 |
| CUUGUAGGGCUCCAGCUCUG | 963 |
| CCUUGUAGGGCUCCAGCUCU | 964 |
| ACAGGCAUUGGAAGCAGCCC | 965 |
| GACAGGCAUUGGAAGCAGCC | 966 |
| AAGGACAGGCAUUGGAAGCA | 967 |
| AAAGGACAGGCAUUGGAAGC | 968 |
| UAAAGGACAGGCAUUGGAAG | 969 |
| CUAAAGGACAGGCAUUGGAA | 970 |
| GCUCUAAAGGACAGGCAUUG | 971 |
| AGCUCUAAAGGACAGGCAUU | 972 |
| AAGCUCUAAAGGACAGGCAU | 973 |
| AAAGCUCUAAAGGACAGGCA | 974 |
| GAAAGCUCUAAAGGACAGGC | 975 |
| CGGGAAAGCUCUAAAGGACA | 976 |
| CCGGGAAAGCUCUAAAGGAC | 977 |
| AGGGUUAAGCUAGAGAGGAA | 978 |
| UCAGGGUUAAGCUAGAGAGG | 979 |
| GAUCAGGGUUAAGCUAGAGA | 980 |
| GGAUCAGGGUUAAGCUAGAG | 981 |
| AGGAUCAGGGUUAAGCUAGA | 982 |
| CCCAGGAUCAGGGUUAAGCU | 983 |
| CAACUCCUCCUGCACCUGGU | 984 |
| ACAACUCCUCCUGCACCUGG | 985 |
| GACAAUUCCACAACUCCUCC | 986 |
| UGACAAUUCCACAACUCCUC | 987 |
| UUGACAAUUCCACAACUCCU | 988 |
| CUUGACAAUUCCACAACUCC | 989 |
| UCCUUGACAAUUCCACAACU | 990 |
| AUCCUUGACAAUUCCACAAC | 991 |
| CAUCCUUGACAAUUCCACAA | 992 |
| ACAUCCUUGACAAUUCCACA | 993 |
| GACAUCCUUGACAAUUCCAC | 994 |
| UGACAUCCUUGACAAUUCCA | 995 |
| UGUGUGACAUCCUUGACAAU | 996 |
| ACUGUGUGACAUCCUUGACA | 997 |
| ACUUUCUGUCCACUGUGUGA | 998 |
| CCUCGCUUGGACUUUCUGUC | 999 |
| CCCUCGCUUGGACUUUCUGU | 1000 |

TABLE 2-continued

| Sequence | SEQ ID NO: |
|---|---|
| UCCCUCGCUUGGACUUUCUG | 1001 |
| CUCCCUCGCUUGGACUUUCU | 1002 |
| CCUCCCUCGCUUGGACUUUC | 1003 |
| CCCUCCCUCGCUUGGACUUU | 1004 |
| UCCAUCAGCACUGGGUCAGA | 1005 |
| ACCACUAAUCUCCAUCAGCA | 1006 |
| CACCACUAAUCUCCAUCAGC | 1007 |
| CCACCACUAAUCUCCAUCAG | 1008 |
| CCCACCACUAAUCUCCAUCA | 1009 |
| ACCAGACACCCACCACUAAU | 1010 |
| UACCAGACACCCACCACUAA | 1011 |
| CUCAUACCAGACACCCACCA | 1012 |
| CCUCAUACCAGACACCCACC | 1013 |
| UCCUAUACCAGACACCCAC | 1014 |
| AUCCUCAUACCAGACACCCA | 1015 |
| GAUCCUCAUACCAGACACCC | 1016 |
| AGAUCCUCAUACCAGACACC | 1017 |
| UAGAUCCUCAUACCAGACAC | 1018 |
| GUAGAUCCUCAUACCAGACA | 1019 |
| AGUAGAUCCUCAUACCAGAC | 1020 |
| CAGUAGAUCCUCAUACCAGA | 1021 |
| UGCAGUAGAUCCUCAUACCA | 1022 |
| GUGCAGUAGAUCCUCAUACC | 1023 |
| AGUGCAGUAGAUCCUCAUAC | 1024 |
| ACUCUGUAGGACACCCUUGU | 1025 |
| CACUCUGUAGGACACCCUUG | 1026 |
| CCACUCUGUAGGACACCCUU | 1027 |
| UCCACUCUGUAGGACACCCU | 1028 |
| CUCCACUCUGUAGGACACCC | 1029 |
| ACUCCACUCUGUAGGACACC | 1030 |
| CACUCCACUCUGUAGGACAC | 1031 |
| AGCACUCCACUCUGUAGGAC | 1032 |
| UAUGACAGCACUCCACUCUG | 1033 |
| AUAUGACAGCACUCCACUCU | 1034 |
| UUGCUGUGCUUUGGGCCUCUC | 1035 |
| ACGUCAAAGGUGAAUCGGGC | 1036 |
| CACGUCAAAGGUGAAUCGGG | 1037 |
| ACACGUCAAAGGUGAAUCGG | 1038 |

TABLE 2-continued

| Sequence | SEQ ID NO: |
|---|---|
| UACACGUCAAAGGUGAAUCG | 1039 |
| GUACACGUCAAAGGUGAAUC | 1040 |
| GGCUGCCAAAGAGGUCUCGA | 1041 |
| UCAGGCUGCCAAAGAGGUCU | 1042 |
| CAUUCAGGCUGCCAAAGAGG | 1043 |
| GACAUUCAGGCUGCCAAAGA | 1044 |
| UGACAUUCAGGCUGCCAAAG | 1045 |
| CUUUGACAUUCAGGCUGCCA | 1046 |
| GCUUUGACAUUCAGGCUGCC | 1047 |
| CCGUAGAAUGUGGCUUUGAC | 1048 |
| GCCCGUAGAAUGUGGCUUUG | 1049 |
| UAGAGCCCGUAGAAUGUGGC | 1050 |
| GUAGAGCCCGUAGAAUGUGG | 1051 |
| AGUAGAGCCCGUAGAAUGUG | 1052 |
| AGAGUAGAGCCCGUAGAAUG | 1053 |
| UAGAGUAGAGCCCGUAGAAU | 1054 |
| AUAGAGUAGAGCCCGUAGAA | 1055 |
| CAUAGAGUAGAGCCCGUAGA | 1056 |
| UCAUAGAGUAGAGCCCGUAG | 1057 |
| CUCAUAGAGUAGAGCCCGUA | 1058 |
| GAAAGUCACAACUCAUAGAG | 1059 |
| CCUUGAAAGUCACAACUCAU | 1060 |
| AAGUCCUUGAAAGUCACAAC | 1061 |
| CCAAGUCCUUGAAAGUCACA | 1062 |
| UUCUUUGGGCCAAGUCCUUG | 1063 |
| UUUCUUUGGGCCAAGUCCUU | 1064 |
| UUGAUUUCUGACCUGAGUAC | 1065 |
| GUUGAUUUCUGACCUGAGUA | 1066 |
| GGGACUAUCCAACUGUAGGG | 1067 |
| GCAAGAGGACGAAUUAUGGG | 1068 |
| UGCAAGAGGACGAAUUAUGG | 1069 |
| GUGCAAGAGGACGAAUUAUG | 1070 |
| GGUGCAAGAGGACGAAUUAU | 1071 |
| GGGUGCAAGAGGACGAAUUA | 1072 |
| UGGGUGCAAGAGGACGAAUU | 1073 |
| GUGGGUGCAAGAGGACGAAU | 1074 |
| GGUGGGUGCAAGAGGACGAA | 1075 |
| UAGGUGGGUGCAAGAGGACG | 1076 |

TABLE 2-continued

| Sequence | SEQ ID NO: |
|---|---|
| GUAGGUGGGUGCAAGAGGAC | 1077 |
| GGUAGGUGGGUGCAAGAGGA | 1078 |
| CCACAAGCAAGAGCUAACUA | 1079 |
| ACUUUCCACAAGCAAGAGCU | 1080 |
| GACUUUCCACAAGCAAGAGC | 1081 |
| GGACUUUCCACAAGCAAGAG | 1082 |
| AGGACUUUCCACAAGCAAGA | 1083 |
| GAGGACUUUCCACAAGCAAG | 1084 |
| UGAGGACUUUCCACAAGCAA | 1085 |
| AUGAGGACUUUCCACAAGCA | 1086 |
| GAUGAGGACUUUCCACAAGC | 1087 |
| AGAUGAGGACUUUCCACAAG | 1088 |
| GAGAUGAGGACUUUCCACAA | 1089 |
| GGAGAUGAGGACUUUCCACA | 1090 |
| UGGGAGAUGAGGACUUUCCA | 1091 |
| GCUGGGAGAUGAGGACUUUC | 1092 |
| UCAAGCUGGGAGAUGAGGAC | 1093 |
| AAGCCAUCAAGCUGGGAGAU | 1094 |
| GAAGCCAUCAAGCUGGGAGA | 1095 |
| GGAGGAAGCCAUCAAGCUGG | 1096 |
| GGGAGGAAGCCAUCAAGCUG | 1097 |
| AACUUGGGAGGAAGCCAUCA | 1098 |
| AAACUUGGGAGGAAGCCAUC | 1099 |
| CAGCAGUGUGGAGGUCCAAC | 1100 |
| GCAGCAGUGUGGAGGUCCAA | 1101 |
| UGCAGCAGUGUGGAGGUCCA | 1102 |
| UUGCAGCAGUGUGGAGGUCC | 1103 |
| GGUGGAGGAAAUUCCCAGCA | 1104 |
| ACGAAGGGUGGAGGAAAUUC | 1105 |
| GACGAAGGGUGGAGGAAAUU | 1106 |
| AUGACGAAGGGUGGAGGAAA | 1107 |
| CAUGACGAAGGGUGGAGGAA | 1108 |
| GCAUGACGAAGGGUGGAGGA | 1109 |
| UGCAUGACGAAGGGUGGAGG | 1110 |
| CUGCAUGACGAAGGGUGGAG | 1111 |
| ACUGCAUGACGAAGGGUGGA | 1112 |
| CACUGCAUGACGAAGGGUGG | 1113 |
| CCACUGCAUGACGAAGGGUG | 1114 |

TABLE 2-continued

| Sequence | SEQ ID NO: |
|---|---|
| UCCACUGCAUGACGAAGGGU | 1115 |
| CUCCACUGCAUGACGAAGGG | 1116 |
| CCUCCACUGCAUGACGAAGG | 1117 |
| CCCUCCACUGCAUGACGAAG | 1118 |
| CUUAGUAGGAAUGGAGGCGG | 1119 |
| CCUUAGUAGGAAUGGAGGCG | 1120 |
| CCCUUAGUAGGAAUGGAGGC | 1121 |
| UCGGUUGGAAUGAUUCUGGG | 1122 |
| GUCGGUUGGAAUGAUUCUGG | 1123 |
| GGUCGGUUGGAAUGAUUCUG | 1124 |
| GGGUCGGUUGGAAUGAUUCU | 1125 |
| UGGGUCGGUUGGAAUGAUUC | 1126 |
| GUGGGUCGGUUGGAAUGAUU | 1127 |
| AGUGGGUCGGUUGGAAUGAU | 1128 |
| CAGUGGGUCGGUUGGAAUGA | 1129 |
| GCAGUGGGUCGGUUGGAAUG | 1130 |
| UGCAGUGGGUCGGUUGGAAU | 1131 |
| UUGCAGUGGGUCGGUUGGAA | 1132 |
| UUUGCAGUGGGUCGGUUGGA | 1133 |
| CUUUGCAGUGGGUCGGUUGG | 1134 |
| UCUUUGCAGUGGGUCGGUUG | 1135 |
| UAGUCUUUGCAGUGGGUCGG | 1136 |
| AUAGUCUUUGCAGUGGGUCG | 1137 |
| CUGUCAUAGUCUUUGCAGUG | 1138 |
| UGCUGUCAUAGUCUUUGCAG | 1139 |
| UCUAGCCUGUACUGUCUGCA | 1140 |
| AUCUAGCCUGUACUGUCUGC | 1141 |
| UAUCUAGCCUGUACUGUCUG | 1142 |
| UUAUCUAGCCUGUACUGUCU | 1143 |
| GUUAUCUAGCCUGUACUGUC | 1144 |
| GGUUAUCUAGCCUGUACUGU | 1145 |
| GGGUUAUCUAGCCUGUACUG | 1146 |
| UGGGUUAUCUAGCCUGUACU | 1147 |
| GUGGGUUAUCUAGCCUGUAC | 1148 |
| GGUGGGUUAUCUAGCCUGUA | 1149 |
| GGGUGGGUUAUCUAGCCUGU | 1150 |
| UGGGUGGGUUAUCUAGCCUG | 1151 |
| UUGGGUGGGUUAUCUAGCCU | 1152 |

TABLE 2-continued

| Sequence | SEQ ID NO: |
|---|---|
| AUUGGGUGGGUUAUCUAGCC | 1153 |
| AAUUGGGUGGGUUAUCUAGC | 1154 |
| AAAUUGGGUGGGUUAUCUAG | 1155 |
| GGAAAUUGGGUGGGUUAUCU | 1156 |
| GGGAAAUUGGGUGGGUUAUC | 1157 |
| GAAAGGUUCUGUCACGAGGG | 1158 |
| GCUGAAAGGUUCUGUCACGA | 1159 |
| UGCUGAAAGGUUCUGUCACG | 1160 |
| GGCGUUAUGCUGAAAGGUUC | 1161 |
| AGGCGUUAUGCUGAAAGGUU | 1162 |
| GAGGCGUUAUGCUGAAAGGU | 1163 |
| UGAGGCGUUAUGCUGAAAGG | 1164 |
| GUGAGGCGUUAUGCUGAAAG | 1165 |
| AUGUGAGGCGUUAUGCUGAA | 1166 |
| GAUGUGAGGCGUUAUGCUGA | 1167 |
| GGAUGUGAGGCGUUAUGCUG | 1168 |
| GGGAUGUGAGGCGUUAUGCU | 1169 |
| CUUGGGAUGUGAGGCGUUAU | 1170 |
| AGACUUGGGAUGUGAGGCGU | 1171 |
| UAGACUUGGGAUGUGAGGCG | 1172 |
| AUAGACUUGGGAUGUGAGGC | 1173 |
| UAUAGACUUGGGAUGUGAGG | 1174 |
| GGGUAUAGACUUGGGAUGUG | 1175 |
| AGGGUAUAGACUUGGGAUGU | 1176 |
| AAGGUGGCUAGGAAAGAACA | 1177 |
| AAAGGUGGCUAGGAAAGAAC | 1178 |
| GAAAGGUGGCUAGGAAAGAA | 1179 |
| ACAUCUUGAUCUUGGCCUUU | 1180 |
| GGCUGGGAUCAAGAUGCCUG | 1181 |
| GUCAGGCUGGGAUCAAGAUG | 1182 |
| AGUCAGGCUGGGAUCAAGAU | 1183 |
| CAGUCAGGCUGGGAUCAAGA | 1184 |
| AGCAGUCAGGCUGGGAUCAA | 1185 |
| GAUGUAGCAGCAGUCAGGCU | 1186 |
| GGAUUAGAUGUAGCAGCAGU | 1187 |
| GGGAUUAGAUGUAGCAGCAG | 1188 |
| GACAGGAGGCAUUGGUAGGG | 1189 |
| UUAGGGACAGGAGGCAUUGG | 1190 |
| UUUAGGGACAGGAGGCAUUG | 1191 |
| GAGUUUAGGGACAGGAGGCA | 1192 |
| GGAGUUUAGGGACAGGAGGC | 1193 |
| GCUGUCAUCAGUAUGCUGGG | 1194 |
| GGCUGUCAUCAGUAUGCUGG | 1195 |
| GGGCUGUCAUCAGUAUGCUG | 1196 |
| AGGGCUGUCAUCAGUAUGCU | 1197 |
| AGAGAGGGCUGUCAUCAGUA | 1198 |
| CAGAGAGGGCUGUCAUCAGU | 1199 |
| UCAGAGAGGGCUGUCAUCAG | 1200 |
| GUCAGAGAGGGCUGUCAUCA | 1201 |
| GGUAAAGUCAGAGAGGGCUG | 1202 |
| GGGAAGGGUAUGAAGACAGA | 1203 |

In some embodiments, the antisense nucleic acid molecules targeted to Transcript B comprise or consist of the nucleotide sequences shown in Table 3.

TABLE 3

| Sequence | SEQ ID NO: |
|---|---|
| UUGCCUUCGGCUUGCUCUGG | 1204 |
| CUUGCCUUCGGCUUGCUCUG | 1205 |
| GCUUGCCUUCGGCUUGCUCU | 1206 |
| UGCUUGCCUUCGGCUUGCUC | 1207 |
| GUGCUUGCCUUCGGCUUGCU | 1208 |
| UCGUGCUUGCCUUCGGCUUG | 1209 |
| AUCGUGCUUGCCUUCGGCUU | 1210 |
| CAUCGUGCUUGCCUUCGGCU | 1211 |
| AGCGCCAUCGUGCUUGCCUU | 1212 |
| UGGUGAGCGCCAUCGUGCUU | 1213 |
| CUGAUGCUCGGCUGCUACAG | 1214 |
| GCUGAUGCUCGGCUGCUACA | 1215 |
| UUUCGGGCUGAUGCUCGGCU | 1216 |
| UCCUUUCGGGCUGAUGCUCG | 1217 |
| UUCCUUUCGGGCUGAUGCUC | 1218 |
| CUUCCUUUCGGGCUGAUGCU | 1219 |
| GCUUCCUUUCGGGCUGAUGC | 1220 |
| UGCUUCCUUUCGGGCUGAUG | 1221 |
| GUGCUUCCUUUCGGGCUGAU | 1222 |

TABLE 3-continued

| Sequence | SEQ ID NO: |
|---|---|
| CGUGCUUCCUUUCGGGCUGA | 1223 |
| UCGUGCUUCCUUUCGGGCUG | 1224 |
| UUCGUGCUUCCUUUCGGGCU | 1225 |
| UUUCGUGCUUCCUUUCGGGC | 1226 |
| CUUUCGUGCUUCCUUUCGGG | 1227 |
| GCUUUCGUGCUUCCUUUCGG | 1228 |
| AUGUACGCCAGCGUGCUGCU | 1229 |
| UCAGCAUGUACGCCAGCGUG | 1230 |
| AGGCGGUGUACUACGUGUGC | 1231 |
| AAGGCGGUGUACUACGUGUG | 1232 |
| CAAGGCGGUGUACUACGUGU | 1233 |
| GCAAGGCGGUGUACUACGUG | 1234 |
| UGCAAGGCGGUGUACUACGU | 1235 |
| CUGCAAGGCGGUGUACUACG | 1236 |
| GCUGCAAGGCGGUGUACUAC | 1237 |
| GGCUGCAAGGCGGUGUACUA | 1238 |
| GCUCUUUGUGGCCUUCCUGA | 1239 |
| CGCUCUUUGUGGCCUUCCUG | 1240 |
| CUUCGUGGUGUGGAGCUUGG | 1241 |
| GGCUUCGUGGUGUGGAGCUU | 1242 |
| CAACGGCUUCGUGGUGUGGA | 1243 |
| UGGCAACGGCUUCGUGGUGU | 1244 |
| UGAGCUGGAAGACUUCGCGG | 1245 |
| CUGAGCUGGAAGACUUCGCG | 1246 |
| GCUGAGCUGGAAGACUUCGC | 1247 |
| ACACUGCUGAGCUGGAAGAC | 1248 |
| CGAGACACUGCUGAGCUGGA | 1249 |
| ACGAGACACUGCUGAGCUGG | 1250 |
| AACGAGACACUGCUGAGCUG | 1251 |
| GAACGAGACACUGCUGAGCU | 1252 |
| GGAACGAGACACUGCUGAGC | 1253 |
| GGGAACGAGACACUGCUGAG | 1254 |
| AGGGAACGAGACACUGCUGA | 1255 |
| CAGGGAACGAGACACUGCUG | 1256 |
| CCAGGGAACGAGACACUGCU | 1257 |
| AAGGAUGUCGGUCUGCUACC | 1258 |
| GAAGGAUGUCGGUCUGCUAC | 1259 |
| AGAAGGAUGUCGGUCUGCUA | 1260 |
| UAGGCCCAGAAGGAUGUCGG | 1261 |
| GUAGGCCCAGAAGGAUGUCG | 1262 |
| UGUAGGCCCAGAAGGAUGUC | 1263 |
| CUGUAGGCCCAGAAGGAUGU | 1264 |
| CCUGUAGGCCCAGAAGGAUG | 1265 |
| ACCUGUAGGCCCAGAAGGAU | 1266 |
| CUUCUCAUCGGGCAUCACAG | 1267 |
| CCUUCUCAUCGGGCAUCACA | 1268 |
| ACCUUCUCAUCGGGCAUCAC | 1269 |
| CACCUUCUCAUCGGGCAUCA | 1270 |
| GCACCUUCUCAUCGGGCAUC | 1271 |
| GGCACCUUCUCAUCGGGCAU | 1272 |
| UGGCACCUUCUCAUCGGGCA | 1273 |
| AUGGCACCUUCUCAUCGGGC | 1274 |
| CAUGGCACCUUCUCAUCGGG | 1275 |
| GCAUGGCACCUUCUCAUCGG | 1276 |
| GGCAUGGCACCUUCUCAUCG | 1277 |
| GAGGCAUGGCACCUUCUCAU | 1278 |
| GGAGGCAUGGCACCUUCUCA | 1279 |
| GACUCCCAGGCAGAAAAGAG | 1280 |
| GGACUCCCAGGCAGAAAAGA | 1281 |
| AGGACUCCCAGGCAGAAAAG | 1282 |
| UCAGGACUCCCAGGCAGAAA | 1283 |
| GAAGUCAGGACUCCCAGGCA | 1284 |
| GUGGAAGUCAGGACUCCCAG | 1285 |
| UCGUGGAAGUCAGGACUCCC | 1286 |
| CUCGUGGAAGUCAGGACUCC | 1287 |
| CCUCGUGGAAGUCAGGACUC | 1288 |
| UGGGUCCUCGUGGAAGUCAG | 1289 |
| CUGGGUCCUCGUGGAAGUCA | 1290 |
| UCUGGGUCCUCGUGGAAGUC | 1291 |
| GUCUGGGUCCUCGUGGAAGU | 1292 |
| AAGAAGGAGUUGUGUUUGAG | 1293 |
| CCAAGAAGGAGUUGUGUUUG | 1294 |
| GUUCCAAGAAGGAGUUGUGU | 1295 |
| GGUUCCAAGAAGGAGUUGUG | 1296 |
| CAGGUCAACUGACUGGGAGC | 1297 |
| UGCCUGUUUACCACUGAGCU | 1298 |

TABLE 3-continued

| Sequence | SEQ ID NO: |
|---|---|
| AUGCCUGUUUACCACUGAGC | 1299 |
| UAUGCCUGUUUACCACUGAG | 1300 |
| UUAUGCCUGUUUACCACUGA | 1301 |
| UUUAUGCCUGUUUACCACUG | 1302 |
| CUUUAUGCCUGUUUACCACU | 1303 |
| ACUUUAUGCCUGUUUACCAC | 1304 |
| UAGAGAUAGUGACAGCCUGG | 1305 |
| GUAGAGAUAGUGACAGCCUG | 1306 |
| UGGUGGUAGAGAUAGUGACA | 1307 |
| GUGGUGGUAGAGAUAGUGAC | 1308 |
| UAGAGGAGUGGUGGUAGAGA | 1309 |
| ACUAGAGGAGUGGUGGUAGA | 1310 |
| AGACUAGAGGAGUGGUGGUA | 1311 |
| CAGACUAGAGGAGUGGUGGU | 1312 |
| CCAGACUAGAGGAGUGGUGG | 1313 |
| GCCAGACUAGAGGAGUGGUG | 1314 |
| GGCCAGACUAGAGGAGUGGU | 1315 |
| GCCCAGAUGUGCUAGAAUGG | 1316 |
| UGCCCAGAUGUGCUAGAAUG | 1317 |
| UUGCCCAGAUGUGCUAGAAU | 1318 |
| UUUGCCCAGAUGUGCUAGAA | 1319 |
| UUUUGCCCAGAUGUGCUAGA | 1320 |
| CCAGUUUUGCCCAGAUGUGC | 1321 |
| AUCCAGUUUUGCCCAGAUGU | 1322 |
| CCAUCCAGUUUUGCCCAGAU | 1323 |
| CACCAUCCAGUUUUGCCCAG | 1324 |
| CCACCAUCCAGUUUUGCCCA | 1325 |
| CCCACCAUCCAGUUUUGCCC | 1326 |
| UUGCUCCCAGCUUGGUAAGU | 1327 |
| GCUUGCUCCCAGCUUGGUAA | 1328 |
| AUCCUGCUUGCUCCCAGCUU | 1329 |
| AAUCCUGCUUGCUCCCAGCU | 1330 |
| CAAUCCUGCUUGCUCCCAGC | 1331 |
| CCAAUCCUGCUUGCUCCCAG | 1332 |
| AACCUUUCAGCUUCUCCAGG | 1333 |
| UAACCUUUCAGCUUCUCCAG | 1334 |
| UUAACCUUUCAGCUUCUCCA | 1335 |
| ACUGCUGCUUAACCUUUCAG | 1336 |
| UACUGCUGCUUAACCUUUCA | 1337 |
| CUACUGCUGCUUAACCUUUC | 1338 |
| CCUACUGCUGCUUAACCUUU | 1339 |
| GCCUACUGCUGCUUAACCUU | 1340 |
| CAGGACAGGAGUAGGCACCU | 1341 |
| ACAGGACAGGAGUAGGCACC | 1342 |
| GCACAGGACAGGAGUAGGCA | 1343 |
| AUAGGCACAGGACAGGAGUA | 1344 |
| GAUAGGCACAGGACAGGAGU | 1345 |
| UGAUAGGCACAGGACAGGAG | 1346 |
| ACCCUCUGCAAAUGUGAUAG | 1347 |
| CUUACCCUCUGCAAAUGUGA | 1348 |
| GUCUUACCCUCUGCAAAUGU | 1349 |
| UGUCUUACCCUCUGCAAAUG | 1350 |
| UUGUCUUACCCUCUGCAAAU | 1351 |
| CUUGUCUUACCCUCUGCAAA | 1352 |
| UCUUGUCUUACCCUCUGCAA | 1353 |
| CAUUCUUGUCUUACCCUCUG | 1354 |
| CCCAUUCUUGUCUUACCCUC | 1355 |
| GAGCCUCAUCUUGUCCCUCC | 1356 |
| UGAGCCUCAUCUUGUCCCUC | 1357 |
| UGCGUUGGUGAUGGGAAGGA | 1358 |
| GUGCGUUGGUGAUGGGAAGG | 1359 |
| GGUGCGUUGGUGAUGGGAAG | 1360 |
| GGGUGCGUUGGUGAUGGGAA | 1361 |
| UGGGUGCGUUGGUGAUGGGA | 1362 |
| UCUCACAUGCCUGGACGCCU | 1363 |
| CAAGGCAGGCUCUCACAUGC | 1364 |
| UGCUGUUUCCUGGCAAGGCA | 1365 |
| UUGUGCUGUUUCCUGGCAAG | 1366 |
| CUUGUGCUGUUUCCUGGCAA | 1367 |
| ACCACCAGGGAAUCUUACUG | 1368 |
| UCCACCACCAGGGAAUCUUA | 1369 |
| AUUUCCUUCCACCACCAGGG | 1370 |
| UAUUUCCUUCCACCACCAGG | 1371 |
| CCUAUUUCCUUCCACCACCA | 1372 |
| AGUCCUCCUAUUUCCUUCCA | 1373 |
| AGAGUCCUCCUAUUUCCUUC | 1374 |

TABLE 3-continued

| Sequence | SEQ ID NO: |
|---|---|
| AGCAGAGUCCUCCUAUUUCC | 1375 |
| CAGCAGAGUCCUCCUAUUUC | 1376 |
| AUUCAGCAGAGUCCUCCUAU | 1377 |
| ACCAGGAUUCAGCAGAGUCC | 1378 |
| GACCAGGAUUCAGCAGAGUC | 1379 |
| GGACCAGGAUUCAGCAGAGU | 1380 |
| CAGGACCAGGAUUCAGCAGA | 1381 |
| CAGAAGCAGGACCAGGAUUC | 1382 |
| ACAGAAGCAGGACCAGGAUU | 1383 |
| AACAGAAGCAGGACCAGGAU | 1384 |
| AGAACAGAAGCAGGACCAGG | 1385 |
| GGGAGGGAUGAGAACAGAAG | 1386 |
| CAGGCAACAUACACACUGCA | 1387 |
| CCAGGCAACAUACACACUGC | 1388 |
| ACCAGGCAACAUACACACUG | 1389 |
| AGACCAGGCAACAUACACAC | 1390 |
| GAGAGACCAGGCAACAUACA | 1391 |
| CCAGAGAGACCAGGCAACAU | 1392 |
| UUGUUUGGGUCACCUCUGCA | 1393 |
| GUUGUUUGGGUCACCUCUGC | 1394 |
| AGUUGUUUGGGUCACCUCUG | 1395 |
| UGAGUUGUUUGGGUCACCUC | 1396 |
| CUGAGUUGUUUGGGUCACCU | 1397 |
| GACUGAGUUGUUUGGGUCAC | 1398 |
| AAACAGGCAAGGAUAAGGCA | 1399 |
| ACAUGGAAAAGCUGUCAUUG | 1400 |
| CCUUACAUGGAAAAGCUGUC | 1401 |
| GCCUUACAUGGAAAAGCUGU | 1402 |
| CUCCUGGAACCUAGCACCAU | 1403 |
| CCUCCUGGAACCUAGCACCA | 1404 |
| UCCUCCUGGAACCUAGCACC | 1405 |
| AACCAUUAUGCCUCCAUGCA | 1406 |
| UAACCAUUAUGCCUCCAUGC | 1407 |
| CUAACCAUUAUGCCUCCAUG | 1408 |
| CCUAACCAUUAUGCCUCCAU | 1409 |
| CCCUAACCAUUAUGCCUCCA | 1410 |
| ACUCCCUAACCAUUAUGCCU | 1411 |
| GACUCCCUAACCAUUAUGCC | 1412 |
| UGACUCCCUAACCAUUAUGC | 1413 |
| AUGACUCCCUAACCAUUAUG | 1414 |
| CAUGACUCCCUAACCAUUAU | 1415 |
| GGGCCUCUUCAUGGUUGUGU | 1416 |
| UGGUGCAGCCUGGUAAUGGG | 1417 |
| CUGGUGCAGCCUGGUAAUGG | 1418 |
| CCUGGUGCAGCCUGGUAAUG | 1419 |
| AUCCUGGUGCAGCCUGGUAA | 1420 |
| UAUCCUGGUGCAGCCUGGUA | 1421 |
| GUAUCCUGGUGCAGCCUGGU | 1422 |
| UGUAUCCUGGUGCAGCCUGG | 1423 |
| UCUUGUAUCCUGGUGCAGCC | 1424 |
| GUCUUGUAUCCUGGUGCAGC | 1425 |
| UGUCUUGUAUCCUGGUGCAG | 1426 |
| UUGUCUUGUAUCCUGGUGCA | 1427 |
| CUUGUCUUGUAUCCUGGUGC | 1428 |
| UCUUGUCUUGUAUCCUGGUG | 1429 |
| UUCUUGUCUUGUAUCCUGGU | 1430 |
| UUUCUUGUCUUGUAUCCUGG | 1431 |
| CCUUUCUUGUCUUGUAUCCU | 1432 |
| ACUCAUCCUUUCCUUUCUUG | 1433 |
| CCUACUCAUCCUUUCCUUUC | 1434 |
| CCCUACUCAUCCUUUCCUUU | 1435 |
| UCCCUACUCAUCCUUUCCUU | 1436 |
| GCUUCUAGUAUGUCCCUAC | 1437 |
| GCUGCUUCUUAGUAUGUCCC | 1438 |
| GGCUGCUUCUUAGUAUGUCC | 1439 |
| GGGCUGCUUCUUAGUAUGUC | 1440 |
| AGGGCUGCUUCUUAGUAUGU | 1441 |
| GAGAGGGCUGCUUCUUAGUA | 1442 |
| UCCAAGAGGAGAGGGCUGCU | 1443 |
| UUGACUUUCCAAGAGGAGA | 1444 |
| AGCUCUAUCCAUCUGCCAGG | 1445 |
| GCUGUUACUUGAGCAGAGGC | 1446 |
| GGCUGUUACUUGAGCAGAGG | 1447 |
| UGGCUGUUACUUGAGCAGAG | 1448 |
| CUGGCUGUUACUUGAGCAGA | 1449 |
| UCUGGCUGUUACUUGAGCAG | 1450 |

TABLE 3-continued

| Sequence | SEQ ID NO: |
|---|---|
| CCUCAAGUUCUGGCUGUUAC | 1451 |
| ACCUCAAGUUCUGGCUGUUA | 1452 |
| CAACCUCAAGUUCUGGCUGU | 1453 |
| GCAACCUCAAGUUCUGGCUG | 1454 |
| AGCAACCUCAAGUUCUGGCU | 1455 |
| CAAGCAACCUCAAGUUCUGG | 1456 |
| CCAAGCAACCUCAAGUUCUG | 1457 |
| CCCAAGCAACCUCAAGUUCU | 1458 |
| ACUAAGACAGUGCUCCUGGU | 1459 |
| CAAACUAAGACAGUGCUCCU | 1460 |
| AGCUCUGCUUUGGAAGAACC | 1461 |
| CCCUUAGCUCAAGCUCUGCU | 1462 |
| GCCCUUAGCUCAAGCUCUGC | 1463 |
| AAGCCCUUAGCUCAAGCUCU | 1464 |
| CAAGCCCUUAGCUCAAGCUC | 1465 |
| CCAAGCCCUUAGCUCAAGCU | 1466 |
| CCCAAGCCCUUAGCUCAAGC | 1467 |
| GUACCCAAGCCCUUAGCUCA | 1468 |
| UGUACCCAAGCCCUUAGCUC | 1469 |
| CUGUACCCAAGCCCUUAGCU | 1470 |
| CCUGUACCCAAGCCCUUAGC | 1471 |
| ACCUGUACCCAAGCCCUUAG | 1472 |
| UCACCUGUACCCAAGCCCUU | 1473 |
| AUCACCUGUACCCAAGCCCU | 1474 |
| GGAUCACCUGUACCCAAGCC | 1475 |
| CUCAAGAAUACAGGAUCACC | 1476 |
| CUUAGCUCAAGAAUACAGGA | 1477 |
| CCUUAGCUCAAGAAUACAGG | 1478 |
| GCCCUUAGCUCAAGAAUACA | 1479 |
| AGCCCUUAGCUCAAGAAUAC | 1480 |
| AAGCCCUUAGCUCAAGAAUA | 1481 |
| CAAGCCCUUAGCUCAAGAAU | 1482 |
| CCAAGCCCUUAGCUCAAGAA | 1483 |
| CCCAAGCCCUUAGCUCAAGA | 1484 |
| GUACCCAAGCCCUUAGCUCA | 1485 |
| UGUACCCAAGCCCUUAGCUC | 1486 |
| CUGUACCCAAGCCCUUAGCU | 1487 |
| CCUGUACCCAAGCCCUUAGC | 1488 |

TABLE 3-continued

| Sequence | SEQ ID NO: |
|---|---|
| ACCUGUACCCAAGCCCUUAG | 1489 |
| UCACCUGUACCCAAGCCCUU | 1490 |
| AUCACCUGUACCCAAGCCCU | 1491 |
| GGAUCACCUGUACCCAAGCC | 1492 |
| UAACCUCCCAAAUACAGGAU | 1493 |
| UACCUUAUGCCCUCACUUCC | 1494 |
| UUACCUUAUGCCCUCACUUC | 1495 |
| UUUACCUUAUGCCCUCACUU | 1496 |
| UUUUACCUUAUGCCCUCACU | 1497 |
| UUGUUUACCUUAUGCCCUC | 1498 |
| CUUGUUUACCUUAUGCCCU | 1499 |
| UUAAUGGCUUUCCUCUCUCU | 1500 |
| ACUCUUAAUGGCUUUCCUCU | 1501 |
| UACUCUUAAUGGCUUUCCUC | 1502 |
| CAUACUCUUAAUGGCUUUCC | 1503 |
| GAAGGGACUUAACAUACUCU | 1504 |
| UGAAGGGACUUAACAUACUC | 1505 |
| ACUGAAGGGACUUAACAUAC | 1506 |
| CUACUGAAGGGACUUAACAU | 1507 |
| GCCUACUGAAGGGACUUAAC | 1508 |
| GGCCUACUGAAGGGACUUAA | 1509 |
| UUCUCAGAGGUUCCCAAGGC | 1510 |
| UUUUCUCAGAGGUUCCCAAG | 1511 |
| ACUUUUCUCAGAGGUUCCCA | 1512 |
| UACUUUUCUCAGAGGUUCCC | 1513 |
| GGGCAAUCUAUACUUUUCUC | 1514 |
| UGUCUUGGGCAAUCUAUACU | 1515 |
| CCAGUCUUUUGUCUUGGGCA | 1516 |
| GCCAGUCUUUUGUCUUGGGC | 1517 |
| UGCCAGUCUUUUGUCUUGGG | 1518 |
| CUGCCAGUCUUUUGUCUUGG | 1519 |
| UCACCCUGCCAGUCUUUUGU | 1520 |
| AUCACCCUGCCAGUCUUUUG | 1521 |
| GCCCACUCAUUAAGUACAUU | 1522 |
| CUGUAGCCCACUCAUUAAGU | 1523 |
| CGCUGUAGCCCACUCAUUAA | 1524 |
| ACGCUGUAGCCCACUCAUUA | 1525 |
| UACGCUGUAGCCCACUCAUU | 1526 |

TABLE 3-continued

| Sequence | SEQ ID NO: |
|---|---|
| AUACGCUGUAGCCCACUCAU | 1527 |
| GAUACGCUGUAGCCCACUCA | 1528 |
| GGAUACGCUGUAGCCCACUC | 1529 |
| AGGAUACGCUGUAGCCCACU | 1530 |
| GAGGAUACGCUGUAGCCCAC | 1531 |
| UGAGGAUACGCUGUAGCCCA | 1532 |
| GUGAGGAUACGCUGUAGCCC | 1533 |
| UGUGAGGAUACGCUGUAGCC | 1534 |
| CUGUUGUGAGGAUACGCUGU | 1535 |
| UCUGUUGUGAGGAUACGCUG | 1536 |
| GUCUGUUGUGAGGAUACGCU | 1537 |
| UGUCUGUUGUGAGGAUACGC | 1538 |
| ACUGUCUGUUGUGAGGAUAC | 1539 |
| CACUGUCUGUUGUGAGGAUA | 1540 |
| CAACUCUCUCUCACUGUCUG | 1541 |
| AACAACUCUCUCUCACUGUC | 1542 |
| AGAACAACUCUCUCUCACUG | 1543 |
| GUAGAACAACUCUCUCUCAC | 1544 |
| GGUAGAACAACUCUCUCUCA | 1545 |
| CAGGUAGAACAACUCUCUCU | 1546 |
| CCAGGUAGAACAACUCUCUC | 1547 |
| ACCCAGGUAGAACAACUCUC | 1548 |
| UAUACCCAGGUAGAACAACU | 1549 |
| AUAUACCCAGGUAGAACAAC | 1550 |
| GGAUAUACCCAGGUAGAACA | 1551 |
| GUUUUGGAUAUACCCAGGUA | 1552 |
| CCUUGUUUUGGAUAUACCCA | 1553 |
| CCCUUGUUUUGGAUAUACCC | 1554 |
| CCUCGUAAACUCCAUACCCU | 1555 |
| CCCUCGUAAACUCCAUACCC | 1556 |
| ACCCUCGUAAACUCCAUACC | 1557 |
| AACCCUCGUAAACUCCAUAC | 1558 |
| GAACCCUCGUAAACUCCAUA | 1559 |
| UGAACCCUCGUAAACUCCAU | 1560 |
| UUGAACCCUCGUAAACUCCA | 1561 |
| CUUGAACCCUCGUAAACUCC | 1562 |
| CCUUGAACCCUCGUAAACUC | 1563 |
| ACCUUGAACCCUCGUAAACU | 1564 |
| UACCUUGAACCCUCGUAAAC | 1565 |
| AUACCUUGAACCCUCGUAAA | 1566 |
| AAUACCUUGAACCCUCGUAA | 1567 |
| AAAUACCUUGAACCCUCGUA | 1568 |
| CAAAUACCUUGAACCCUCGU | 1569 |
| CCAAAUACCUUGAACCCUCG | 1570 |
| ACCAAAUACCUUGAACCCUC | 1571 |
| AACCAAAUACCUUGAACCCU | 1572 |
| GAACCAAAUACCUUGAACCC | 1573 |
| UGAACCAAAUACCUUGAACC | 1574 |
| CCCUGAACCAAAUACCUUGA | 1575 |
| GGCCCUGAACCAAAUACCUU | 1576 |
| UGGCCCUGAACCAAAUACCU | 1577 |
| UAUUCAGGUUGUUGCCCAAA | 1578 |
| GGUAUUCAGGUUGUUGCCCA | 1579 |
| AGGUAUUCAGGUUGUUGCCC | 1580 |
| AAGGUAUUCAGGUUGUUGCC | 1581 |
| AAAGGUAUUCAGGUUGUUGC | 1582 |
| UAACUUGAUUGCCCUGUGAC | 1583 |
| GUAACUUGAUUGCCCUGUGA | 1584 |
| AGUAACUUGAUUGCCCUGUG | 1585 |
| CAGAGUAACUUGAUUGCCCU | 1586 |
| ACAGAGUAACUUGAUUGCCC | 1587 |
| CACAGAGUAACUUGAUUGCC | 1588 |
| UGUCCUGACAAAGAAACACA | 1589 |
| CAAUCCCUGCUUUCCUGCCA | 1590 |
| ACAAUCCCUGCUUUCCUGCC | 1591 |
| AACACAAUCCCUGCUUUCCU | 1592 |
| GAACACAAUCCCUGCUUUCC | 1593 |
| AAUGAACACAAUCCCUGCUU | 1594 |
| AAAUGAACACAAUCCCUGCU | 1595 |
| GUGAAACCCUCAAAUGAACA | 1596 |
| AGUGAAACCCUCAAAUGAAC | 1597 |
| CAGUGAAACCCUCAAAUGAA | 1598 |
| ACAGUGAAACCCUCAAAUGA | 1599 |
| GCAUGGAAGCUGAGACUCUC | 1600 |
| UUGCAUGGAAGCUGAGACUC | 1601 |
| CAGUUGCAUGGAAGCUGAGA | 1602 |

TABLE 3-continued

| Sequence | SEQ ID NO: |
|---|---|
| ACAGUUGCAUGGAAGCUGAG | 1603 |
| GACAGUUGCAUGGAAGCUGA | 1604 |
| AUGGACAGUUGCAUGGAAGC | 1605 |
| GUGAUGGACAGUUGCAUGGA | 1606 |
| CGUGAUGGACAGUUGCAUGG | 1607 |
| CCGUGAUGGACAGUUGCAUG | 1608 |
| GCCGUGAUGGACAGUUGCAU | 1609 |
| AGCCGUGAUGGACAGUUGCA | 1610 |
| CAGCCGUGAUGGACAGUUGC | 1611 |
| GCAGCCGUGAUGGACAGUUG | 1612 |
| UGCAGCCGUGAUGGACAGUU | 1613 |
| UUGCAGCCGUGAUGGACAGU | 1614 |
| GUUGCAGCCGUGAUGGACAG | 1615 |
| CAGUUGCAGCCGUGAUGGAC | 1616 |
| UCAGUUGCAGCCGUGAUGGA | 1617 |
| UUCAGUUGCAGCCGUGAUGG | 1618 |
| UUUCAGUUGCAGCCGUGAUG | 1619 |
| AUUUCAGUUGCAGCCGUGAU | 1620 |
| GAUUUCAGUUGCAGCCGUGA | 1621 |
| UGAUUUCAGUUGCAGCCGUG | 1622 |
| CUCUGAUUUCAGUUGCAGCC | 1623 |
| UUAGCUUCUGGUGCGCUGUG | 1624 |
| UUUAGCUUCUGGUGCGCUGU | 1625 |
| CUUUAGCUUCUGGUGCGCUG | 1626 |
| GACUUUAGCUUCUGGUGCGC | 1627 |
| AGACUUUAGCUUCUGGUGCG | 1628 |
| AAGACUUUAGCUUCUGGUGC | 1629 |
| UCAAGACUUUAGCUUCUGGU | 1630 |
| AUCAAGACUUUAGCUUCUGG | 1631 |
| GCAUCAAGACUUUAGCUUCU | 1632 |
| AUGGCAUCAAGACUUUAGCU | 1633 |
| GAUGGCAUCAAGACUUUAGC | 1634 |
| AGGGAUGUCCUUUGAUGGCA | 1635 |
| GCAGGGAUGUCCUUUGAUGG | 1636 |
| GGCAGGGAUGUCCUUUGAUG | 1637 |
| CGUGACAGAGAUGUGAAUGG | 1638 |
| GGACGUGACAGAGAUGUGAA | 1639 |
| UGGACGUGACAGAGAUGUGA | 1640 |
| GUGGACGUGACAGAGAUGUG | 1641 |
| AGUGGACGUGACAGAGAUGU | 1642 |
| UAGUGGACGUGACAGAGAUG | 1643 |
| UUAGUGGACGUGACAGAGAU | 1644 |
| AUUAGUGGACGUGACAGAGA | 1645 |
| GAUUAGUGGACGUGACAGAG | 1646 |
| CGAUUAGUGGACGUGACAGA | 1647 |
| CCGAUUAGUGGACGUGACAG | 1648 |
| UGCCGAUUAGUGGACGUGAC | 1649 |
| UUGCCGAUUAGUGGACGUGA | 1650 |
| UUUGCCGAUUAGUGGACGUG | 1651 |
| UUUUGCCGAUUAGUGGACGU | 1652 |
| CUUUUGCCGAUUAGUGGACG | 1653 |
| CCUUUUGCCGAUUAGUGGAC | 1654 |
| UCCUUUUGCCGAUUAGUGGA | 1655 |
| CUCCUUUUGCCGAUUAGUGG | 1656 |
| UCUCCUUUUGCCGAUUAGUG | 1657 |
| UUCUCCUUUUGCCGAUUAGU | 1658 |
| UUUCUCCUUUUGCCGAUUAG | 1659 |
| AGGUCAUCUUCUCUCACUUU | 1660 |
| UUAGGUCAUCUUCUCUCACU | 1661 |
| CUUAGGUCAUCUUCUCUCAC | 1662 |
| ACACUUAGGUCAUCUUCUCU | 1663 |
| CACACUUAGGUCAUCUUCUC | 1664 |
| UCACACUUAGGUCAUCUUCU | 1665 |
| GUCACACUUAGGUCAUCUUC | 1666 |
| AGUCACACUUAGGUCAUCUU | 1667 |
| CAGUCACACUUAGGUCAUCU | 1668 |
| GCAGUCACACUUAGGUCAUC | 1669 |
| UGCAGUCACACUUAGGUCAU | 1670 |
| AUUUUCCAGAGCUGCCUGCU | 1671 |
| CUCACUGCUCUGGCUUCAUU | 1672 |
| GCUCACUGCUCUGGCUUCAU | 1673 |
| UUACCUGCUCUUUCCUUCCU | 1674 |
| UGCUUACCUGCUCUUUCCUU | 1675 |
| UUCCUGCUUACCUGCUCUUU | 1676 |
| CUUCCUGCUUACCUGCUCUU | 1677 |
| ACUGGCCUUCCUGCUUACCU | 1678 |

TABLE 3-continued

| Sequence | SEQ ID NO: |
|---|---|
| GACACUGGCCUUCCUGCUUA | 1679 |
| CAUUAGGGUCCUGUCUGGGA | 1680 |
| UCAUUAGGGUCCUGUCUGGG | 1681 |
| AUCAUUAGGGUCCUGUCUGG | 1682 |
| GAUCAUUAGGGUCCUGUCUG | 1683 |
| GGAUCAUUAGGGUCCUGUCU | 1684 |
| AUUCAGGAUCAUUAGGGUCC | 1685 |
| GAUUCAGGAUCAUUAGGGUC | 1686 |
| GGAUUCAGGAUCAUUAGGGU | 1687 |
| AUGGAUUCAGGAUCAUUAGG | 1688 |
| GAUACAUGGAUUCAGGAUCA | 1689 |
| UGAUACAUGGAUUCAGGAUC | 1690 |
| AUGGCAGGGCUUUGGAAAAU | 1691 |
| CAUGGCAGGGCUUUGGAAAA | 1692 |
| GCAUGGCAGGGCUUUGGAAA | 1693 |
| CAGCAUGGCAGGGCUUUGGA | 1694 |
| GAAGUGGGAUGGCAGCAUGG | 1695 |
| GGAAGUGGGAUGGCAGCAUG | 1696 |
| GGGAAGUGGGAUGGCAGCAU | 1697 |
| UGGAGAAGCCAUAAGCUGCA | 1698 |
| CUGGAGAAGCCAUAAGCUGC | 1699 |
| ACUGGAGAAGCCAUAAGCUG | 1700 |
| UACUGGAGAAGCCAUAAGCU | 1701 |
| CUACUGGAGAAGCCAUAAGC | 1702 |
| CCUACUGGAGAAGCCAUAAG | 1703 |
| ACCUACUGGAGAAGCCAUAA | 1704 |
| CACCUACUGGAGAAGCCAUA | 1705 |
| CCACCUACUGGAGAAGCCAU | 1706 |
| GCCACCUACUGGAGAAGCCA | 1707 |
| CUGCCACCUACUGGAGAAGC | 1708 |
| GCUGCCACCUACUGGAGAAG | 1709 |
| UGUGUGUGCUGCCACCUACU | 1710 |
| CUGUGUGUGCUGCCACCUAC | 1711 |
| UUAUGAGUGGCUCUGUGUGU | 1712 |
| UUUAUGAGUGGCUCUGUGUG | 1713 |
| AGUUUAUGAGUGGCUCUGUG | 1714 |
| CAGUUUAUGAGUGGCUCUGU | 1715 |
| GUUUCUGGCUCUCAGGCUCU | 1716 |

TABLE 3-continued

| Sequence | SEQ ID NO: |
|---|---|
| GGUUUCUGGCUCUCAGGCUC | 1717 |
| CGGUUUCUGGCUCUCAGGCU | 1718 |
| GGACGGUUUCUGGCUCUCAG | 1719 |
| GGGACGGUUUCUGGCUCUCA | 1720 |
| UGAAAUGUGACUUCUGGUGU | 1721 |
| GGGAACCAUGUAAAAGGAUG | 1722 |
| GUGAGGGUAGAUGGGAACCA | 1723 |
| UUGUGAGGGUAGAUGGGAAC | 1724 |
| GUUGUGAGGGUAGAUGGGAA | 1725 |
| UGUUGUGAGGGUAGAUGGGA | 1726 |
| AUGUGUGUCUUUGGUGAUGA | 1727 |
| GGAGCUUGUAUGUGUGUCUU | 1728 |
| UUGGAGCUUGUAUGUGUGUC | 1729 |
| AUUGGAGCUUGUAUGUGUGU | 1730 |
| CAUUGGAGCUUGUAUGUGUG | 1731 |
| CCAUUGGAGCUUGUAUGUGU | 1732 |
| GCCAUUGGAGCUUGUAUGUG | 1733 |
| AGCCAUUGGAGCUUGUAUGU | 1734 |
| CUGGAGGAAGAAUUGCCUGG | 1735 |
| GUCCUGGAGGAAGAAUUGCC | 1736 |
| GCCAGUAAGAAGGGCAAAGU | 1737 |
| GGCCAGUAAGAAGGGCAAAG | 1738 |
| GGAAUGAGUCAAGCCUGGAC | 1739 |
| GGGAAUGAGUCAAGCCUGGA | 1740 |
| GUGGGAAUGAGUCAAGCCUG | 1741 |
| AAGGUGGGAAUGAGUCAAGC | 1742 |
| UCUCAGCCCAGGCAAGGUG | 1743 |
| AUCUCAGCCCAGGACAAGGU | 1744 |
| GCUGGGUGGUUCUCUCCUGU | 1745 |
| UUCUGGGCUGGGUGGUUCUC | 1746 |
| GAACUUCUGGGCUGGGUGGU | 1747 |
| CGGAGAGUUCCUUCCCUGGA | 1748 |
| ACCGGAGAGUUCCUUCCCUG | 1749 |
| GACCGGAGAGUUCCUUCCCU | 1750 |
| UGGACCGGAGAGUUCCUUCC | 1751 |
| GUGGACCGGAGAGUUCCUUC | 1752 |
| GGUGGACCGGAGAGUUCCUU | 1753 |
| UGGUGGACCGGAGAGUUCCU | 1754 |

TABLE 3-continued

| Sequence | SEQ ID NO: |
|---|---|
| AUGGUGGACCGGAGAGUUCC | 1755 |
| CAUGGUGGACCGGAGAGUUC | 1756 |
| GAGCUGAGAGGUACUCCAUG | 1757 |
| AGAGCUGAGAGGUACUCCAU | 1758 |
| CAGAGCUGAGAGGUACUCCA | 1759 |
| UUCAGAGCUGAGAGGUACUC | 1760 |
| GGUUCAGAGCUGAGAGGUAC | 1761 |
| GGGUUCAGAGCUGAGAGGUA | 1762 |
| CACCUGAGUAAGUCACUGGG | 1763 |
| UCACCUGAGUAAGUCACUGG | 1764 |
| GUCACCUGAGUAAGUCACUG | 1765 |
| AGUCACCUGAGUAAGUCACU | 1766 |
| CAGUCACCUGAGUAAGUCAC | 1767 |
| GCAGUCACCUGAGUAAGUCA | 1768 |
| UUAGCAGUCACCUGAGUAAG | 1769 |
| GUUAGCAGUCACCUGAGUAA | 1770 |
| GGUUAGCAGUCACCUGAGUA | 1771 |
| GGGUUAGCAGUCACCUGAGU | 1772 |
| AGGGUUAGCAGUCACCUGAG | 1773 |
| GAGGGUUAGCAGUCACCUGA | 1774 |
| GGAGGGUUAGCAGUCACCUG | 1775 |
| CGGAGGGUUAGCAGUCACCU | 1776 |
| AGCGGAGGGUUAGCAGUCAC | 1777 |
| GAGCGGAGGGUUAGCAGUCA | 1778 |
| AGAGCGGAGGGUUAGCAGUC | 1779 |
| UAGAGCGGAGGGUUAGCAGU | 1780 |
| GUAGAGCGGAGGGUUAGCAG | 1781 |
| GGUAGAGCGGAGGGUUAGCA | 1782 |
| AGGGUAGAGCGGAGGGUUAG | 1783 |
| GAGGGUAGAGCGGAGGGUUA | 1784 |
| AUUGUUGCCCUGCCUAUAUC | 1785 |
| AGUAUUGUUGCCCUGCCUAU | 1786 |
| GAGUAUUGUUGCCCUGCCUA | 1787 |
| GGAGUAUUGUUGCCCUGCCU | 1788 |
| UGGAGUAUUGUUGCCCUGCC | 1789 |
| GUGGAGUAUUGUUGCCCUGC | 1790 |
| AGUGGAGUAUUGUUGCCCUG | 1791 |
| GAGUGGAGUAUUGUUGCCCU | 1792 |

TABLE 3-continued

| Sequence | SEQ ID NO: |
|---|---|
| UGAGUGGAGUAUUGUUGCCC | 1793 |
| CUGAGUGGAGUAUUGUUGCC | 1794 |
| GCUGAGUGGAGUAUUGUUGC | 1795 |
| GGCUGAGUGGAGUAUUGUUG | 1796 |
| GGGCUGAGUGGAGUAUUGUU | 1797 |
| GGUACUGGUUAGUCUCCUAG | 1798 |
| GGGUACUGGUUAGUCUCCUA | 1799 |
| UUGACAAGCCCACUGUGGAG | 1800 |
| UGGCUCAGGAGCUUGACAAG | 1801 |
| GGUGGCUCAGGAGCUUGACA | 1802 |
| UAGGGAUGAGGGAGAGACCA | 1803 |
| UCGAUUAGGGAUGAGGGAGA | 1804 |
| UAGAGGGCUAGGGAGGGAGA | 1805 |
| GUAGAGUGGCUAGAGGGCUA | 1806 |
| GGUAGAGUGGCUAGAGGGCU | 1807 |
| UGAGGGUAGAGUGGCUAGAG | 1808 |
| GAUGAGGGUAGAGUGGCUAG | 1809 |
| CAUGAUGAGGGUAGAGUGGC | 1810 |
| GCAUGAUGAGGGUAGAGUGG | 1811 |
| GGGCAUGAUGAGGGUAGAGU | 1812 |
| GGUAGUUGAGAAGAAAAGUC | 1813 |
| CCAAACUCCGAGCUUAUAUU | 1814 |
| UCCAAACUCCGAGCUUAUAU | 1815 |
| GUCCAAACUCCGAGCUUAUA | 1816 |
| CGUCCAAACUCCGAGCUUAU | 1817 |
| CCGUCCAAACUCCGAGCUUA | 1818 |
| UCCGUCCAAACUCCGAGCUU | 1819 |
| CUCCGUCCAAACUCCGAGCU | 1820 |
| ACCCUCCGUCCAAACUCCGA | 1821 |
| AGACCCUCCGUCCAAACUCC | 1822 |
| CAGACCCUCCGUCCAAACUC | 1823 |
| UCCAGACCCUCCGUCCAAAC | 1824 |
| GUCCAGACCCUCCGUCCAAA | 1825 |
| AGACACGGAAAGGUCGCUGG | 1826 |
| CAGACACGGAAAGGUCGCUG | 1827 |
| ACAGACACGGAAAGGUCGCU | 1828 |
| CACAGACACGGAAAGGUCGC | 1829 |
| UCACAGACACGGAAAGGUCG | 1830 |

TABLE 3-continued

| Sequence | SEQ ID NO: |
|---|---|
| AUCACAGACACGGAAAGGUC | 1831 |
| GAUCACAGACACGGAAAGGU | 1832 |
| UUGGCCUACUUACUUUGGCU | 1833 |
| CUUGGCCUACUUACUUUGGC | 1834 |
| ACUUGGCCUACUUACUUUGG | 1835 |
| GAGGAACUUGGCCUACUUAC | 1836 |
| CGAGGAACUUGGCCUACUUA | 1837 |
| CCGAGGAACUUGGCCUACUU | 1838 |
| ACCGAGGAACUUGGCCUACU | 1839 |
| AACCGAGGAACUUGGCCUAC | 1840 |
| GAACCGAGGAACUUGGCCUA | 1841 |
| GGAACCGAGGAACUUGGCCU | 1842 |
| AGGAACCGAGGAACUUGGCC | 1843 |
| UAGGAACCGAGGAACUUGGC | 1844 |
| AUAGGAACCGAGGAACUUGG | 1845 |
| UAUAGGAACCGAGGAACUUG | 1846 |
| AUCACAAGUUGCCACUGUUG | 1847 |
| CAUCACAAGUUGCCACUGUU | 1848 |
| AUCAUCACAAGUUGCCACUG | 1849 |
| CAUCAUCACAAGUUGCCACU | 1850 |
| CUGCUCCAUCAUCACAAGUU | 1851 |
| UCUGCUCCAUCAUCACAAGU | 1852 |
| CCCUCUGCUCCAUCAUCACA | 1853 |
| UCAGCCCUCUGCUCCAUCAU | 1854 |
| UGACUUCAGCCCUCUGCUCC | 1855 |
| GUGACUUCAGCCCUCUGCUC | 1856 |
| UGUGACUUCAGCCCUCUGCU | 1857 |
| GUGUGACUUCAGCCCUCUGC | 1858 |
| UGUGUGACUUCAGCCCUCUG | 1859 |
| GCCCACUCCGCUGCUUUUAG | 1860 |
| GGCCCACUCCGCUGCUUUUA | 1861 |
| AGGCCCACUCCGCUGCUUUU | 1862 |
| UAGGCCCACUCCGCUGCUUU | 1863 |
| UUAGGCCCACUCCGCUGCUU | 1864 |
| AUUAGGCCCACUCCGCUGCU | 1865 |
| UCAUUAGGCCCACUCCGCUG | 1866 |
| CUCAUUAGGCCCACUCCGCU | 1867 |
| AGCUCAUUAGGCCCACUCCG | 1868 |

TABLE 3-continued

| Sequence | SEQ ID NO: |
|---|---|
| CUCCCAUAGAAAAGCUCACU | 1869 |
| GCUCCCAUAGAAAAGCUCAC | 1870 |
| UGCUCCCAUAGAAAAGCUCA | 1871 |
| CUGCUCCCAUAGAAAAGCUC | 1872 |
| CCUGCUCCCAUAGAAAAGCU | 1873 |
| UCCCUAUCUCCUGCUAACCC | 1874 |
| CCUCGAACUCUCCCUAUCUC | 1875 |
| CCCUCGAACUCUCCCUAUCU | 1876 |
| UCCCUCGAACUCUCCCUAUC | 1877 |
| GUCCCUCGAACUCUCCCUAU | 1878 |
| CUUUCCAUACUAGCUUCUGA | 1879 |
| CCUUUCCAUACUAGCUUCUG | 1880 |
| ACCUUUCCAUACUAGCUUCU | 1881 |
| CACACAAAUCACCUUUCCAU | 1882 |
| GUCACACAAAUCACCUUUCC | 1883 |
| UGUCACACAAAUCACCUUUC | 1884 |
| UUUGACAGGCAGGAAGUGGC | 1885 |
| GGUUUGACAGGCAGGAAGUG | 1886 |
| AGGUUUGACAGGCAGGAAGU | 1887 |
| AAGGUUUGACAGGCAGGAAG | 1888 |
| AACUUCCCAAGGUUUGACAG | 1889 |
| CAACUUCCCAAGGUUUGACA | 1890 |
| GAACAACUUCCCAAGGUUUG | 1891 |
| UGAACAACUUCCCAAGGUUU | 1892 |
| GUAGGUUGAACAACUUCCCA | 1893 |
| GGUAGGUUGAACAACUUCCC | 1894 |
| UGGUAGGUUGAACAACUUCC | 1895 |
| GGUUUUGGUAGGUUGAACAA | 1896 |
| UGAGGUUUUGGUAGGUUGAA | 1897 |
| CUGAGGUUUUGGUAGGUUGA | 1898 |
| CCUACAUUAUCCUCUUACUC | 1899 |
| GGACUUUACCUACAUUAUCC | 1900 |
| GUAUGAGGACUUUACCUACA | 1901 |
| GCCAGGUAUGAGGACUUUAC | 1902 |
| UGCCAGGUAUGAGGACUUUA | 1903 |
| GUGCCAGGUAUGAGGACUUU | 1904 |
| CUGUGCCAGGUAUGAGGACU | 1905 |
| UCUGUGCCAGGUAUGAGGAC | 1906 |

TABLE 3-continued

| Sequence | SEQ ID NO: |
|---|---|
| CCUCAAGAGUUCUCCAGAAG | 1907 |
| CCCUCAAGAGUUCUCCAGAA | 1908 |
| ACCCUCAAGAGUUCUCCAGA | 1909 |
| ACACCCUCAAGAGUUCUCCA | 1910 |
| CACACCCUCAAGAGUUCUCC | 1911 |
| CCACACCCUCAAGAGUUCUC | 1912 |
| CCCACACCCUCAAGAGUUCU | 1913 |
| UUCCCACACCCUCAAGAGUU | 1914 |
| CAAUGCUGCACCUCACUUCC | 1915 |
| UACAAUGCUGCACCUCACUU | 1916 |
| CUACAAUGCUGCACCUCACU | 1917 |
| UCUACAAUGCUGCACCUCAC | 1918 |
| AUCUACAAUGCUGCACCUCA | 1919 |
| UAUCUACAAUGCUGCACCUC | 1920 |
| CUUAUCUACAAUGCUGCACC | 1921 |
| GUCUUAUCUACAAUGCUGCA | 1922 |
| UGUCUUAUCUACAAUGCUGC | 1923 |
| CUGUCUUAUCUACAAUGCUG | 1924 |
| CACCCUUCUGUCUUAUCUAC | 1925 |
| UCCACCCUUCUGUCUUAUCU | 1926 |
| GUCCACCCUUCUGUCUUAUC | 1927 |
| AGUCCACCCUUCUGUCUUAU | 1928 |
| AAGUCCACCCUUCUGUCUUA | 1929 |
| GAAAGCAAGCCAGGUUCUCA | 1930 |
| GGAAAGCAAGCCAGGUUCUC | 1931 |
| GGAAUUGGAAAGCAAGCCAG | 1932 |
| ACCAUGUCAUUGGCAUCUCC | 1933 |
| UACCAUGUCAUUGGCAUCUC | 1934 |
| CCUACCAUGUCAUUGGCAUC | 1935 |
| UCCUACCAUGUCAUUGGCAU | 1936 |
| CUCCUACCAUGUCAUUGGCA | 1937 |
| GCUCCUACCAUGUCAUUGGC | 1938 |
| UGCUCCUACCAUGUCAUUGG | 1939 |
| UCUUUGCUCCUACCAUGUCA | 1940 |
| CCUCUUUGCUCCUACCAUGU | 1941 |
| UUCCUCUUUGCUCCUACCAU | 1942 |
| UCUCCGUGUUCUUCAGUUUU | 1943 |
| CUCUCCGUGUUCUUCAGUUU | 1944 |
| AGCUCUCCGUGUUCUUCAGU | 1945 |
| UGCAGCUCUCCGUGUUCUUC | 1946 |
| GGUUGCAGCUCUCCGUGUUC | 1947 |
| AGGUUGCAGCUCUCCGUGUU | 1948 |
| AAAGGUUGCAGCUCUCCGUG | 1949 |
| UAAAGGUUGCAGCUCUCCGU | 1950 |
| CUAAAGGUUGCAGCUCUCCG | 1951 |
| CCUAAAGGUUGCAGCUCUCC | 1952 |
| UCCUAAAGGUUGCAGCUCUC | 1953 |
| CUCCUAAAGGUUGCAGCUCU | 1954 |
| CCUCCUAAAGGUUGCAGCUC | 1955 |
| GCACUUUGAUACCUCCUAAA | 1956 |
| GGCACUUUGAUACCUCCUAA | 1957 |
| GAUGUCCCACUUUGACUUUC | 1958 |
| UCGAUGUCCCACUUUGACUU | 1959 |
| GUCGAUGUCCCACUUUGACU | 1960 |
| GGUCGAUGUCCCACUUUGAC | 1961 |
| UGGUCGAUGUCCCACUUUGA | 1962 |
| UUGGUCGAUGUCCCACUUUG | 1963 |
| AUUGGUCGAUGUCCCACUUU | 1964 |
| CAUUGGUCGAUGUCCCACUU | 1965 |
| AACAUCCAUCAGUUGGCUCU | 1966 |
| CUGCCCAACAUCCAUCAGUU | 1967 |
| AGCUGCCCAACAUCCAUCAG | 1968 |
| UAGCUGCCCAACAUCCAUCA | 1969 |
| UUAGCUGCCCAACAUCCAUC | 1970 |
| UUUAGCUGCCCAACAUCCAU | 1971 |
| CUUUAGCUGCCCAACAUCCA | 1972 |
| CCUCUUUAGCUGCCCAACAU | 1973 |
| CCCUCUUUAGCUGCCCAACA | 1974 |
| UCCCUCUUUAGCUGCCCAAC | 1975 |
| UUCCCUCUUUAGCUGCCCAA | 1976 |
| CCUUCCCUCUUUAGCUGCCC | 1977 |
| CCCUUCCCUCUUUAGCUGCC | 1978 |
| GCAGGUCUAUCCCAUGCCC | 1979 |
| GGGCAGGUCUUAUCCCAUGC | 1980 |
| AGGGCAGGUCUUAUCCCAUG | 1981 |
| AAGGGCAGGUCUUAUCCCAU | 1982 |

TABLE 3-continued

| Sequence | SEQ ID NO: |
|---|---|
| GAAGGGCAGGUCUUAUCCCA | 1983 |
| AGAAGGGCAGGUCUUAUCCC | 1984 |
| CCAAUGGCAAGAAGCAAGAA | 1985 |
| CCCAAUGGCAAGAAGCAAGA | 1986 |
| GCCCAAUGGCAAGAAGCAAG | 1987 |
| UCCAAUGCCUGCCCAAUGGC | 1988 |
| CUCCAAUGCCUGCCCAAUGG | 1989 |
| UCUCCAAUGCCUGCCCAAUG | 1990 |
| GGUCUCCAAUGCCUGCCCAA | 1991 |
| UAGGGUCUCCAAUGCCUGCC | 1992 |
| GUAGGGUCUCCAAUGCCUGC | 1993 |
| AGUAGGGUCUCCAAUGCCUG | 1994 |
| CAGUAGGGUCUCCAAUGCCU | 1995 |
| GCAGUAGGGUCUCCAAUGCC | 1996 |
| AGCAGUAGGGUCUCCAAUGC | 1997 |
| CAGCAGUAGGGUCUCCAAUG | 1998 |
| UCAGCAGUAGGGUCUCCAAU | 1999 |
| AUUCAGCAGUAGGGUCUCCA | 2000 |
| CAUUCAGCAGUAGGGUCUCC | 2001 |
| CCAUUCAGCAGUAGGGUCUC | 2002 |
| UCCAUUCAGCAGUAGGGUCU | 2003 |
| ACUCCAUUCAGCAGUAGGGU | 2004 |
| CACUCCAUUCAGCAGUAGGG | 2005 |
| GCACUCCAUUCAGCAGUAGG | 2006 |
| AGCACUCCAUUCAGCAGUAG | 2007 |
| UAGCACUCCAUUCAGCAGUA | 2008 |
| GUUAGCACUCCAUUCAGCAG | 2009 |
| GGUUAGCACUCCAUUCAGCA | 2010 |
| GGGUUAGCACUCCAUUCAGC | 2011 |
| CAGGGUUAGCACUCCAUUCA | 2012 |
| CCAGGGUUAGCACUCCAUUC | 2013 |
| ACCAGGGUUAGCACUCCAUU | 2014 |
| CACCAGGGUUAGCACUCCAU | 2015 |
| GCACCAGGGUUAGCACUCCA | 2016 |
| AGCACCAGGGUUAGCACUCC | 2017 |
| UAGCACCAGGGUUAGCACUC | 2018 |
| CUAGCACCAGGGUUAGCACU | 2019 |
| UCUAGCACCAGGGUUAGCAC | 2020 |
| CUCUAGCACCAGGGUUAGCA | 2021 |
| CCUCUAGCACCAGGGUUAGC | 2022 |
| UCCUCUAGCACCAGGGUUAG | 2023 |
| CUCCUCUAGCACCAGGGUUA | 2024 |
| CCUCCUCUAGCACCAGGGUU | 2025 |
| UCCUCCUCUAGCACCAGGGU | 2026 |
| GUUCCAUCCUCCUCUAGCAC | 2027 |
| AAGUCCUCACUGUCCACUGC | 2028 |
| GAAGUCCUCACUGUCCACUG | 2029 |
| AGAAGUCCUCACUGUCCACU | 2030 |
| AAGAAGUCCUCACUGUCCAC | 2031 |
| GAAGAAGUCCUCACUGUCCA | 2032 |
| GGAAGAAGUCCUCACUGUCC | 2033 |
| UGGAAGAAGUCCUCACUGUC | 2034 |
| CUGGAAGAAGUCCUCACUGU | 2035 |
| AGCUGGAAGAAGUCCUCACU | 2036 |
| ACUGCAACACCAUCAGGCAC | 2037 |
| GACUGCAACACCAUCAGGCA | 2038 |
| AGACUGCAACACCAUCAGGC | 2039 |
| CAGACUGCAACACCAUCAGG | 2040 |
| CCAGACUGCAACACCAUCAG | 2041 |
| GACCAGACUGCAACACCAUC | 2042 |
| CUCUGACCAGACUGCAACAC | 2043 |
| AGCUCUGACCAGACUGCAAC | 2044 |
| CCAGCUCUGACCAGACUGCA | 2045 |
| UGUAGGGCUCCAGCUCUGAC | 2046 |
| CUUGUAGGGCUCCAGCUCUG | 2047 |
| CCUUGUAGGGCUCCAGCUCU | 2048 |
| ACAGGCAUUGGAAGCAGCCC | 2049 |
| GACAGGCAUUGGAAGCAGCC | 2050 |
| AAGGACAGGCAUUGGAAGCA | 2051 |
| AAAGGACAGGCAUUGGAAGC | 2052 |
| UAAAGGACAGGCAUUGGAAG | 2053 |
| CUAAAGGACAGGCAUUGGAA | 2054 |
| GCUCUAAAGGACAGGCAUUG | 2055 |
| AGCUCUAAAGGACAGGCAUU | 2056 |
| AAGCUCUAAAGGACAGGCAU | 2057 |
| AAAGCUCUAAAGGACAGGCA | 2058 |

TABLE 3-continued

| Sequence | SEQ ID NO: |
|---|---|
| GAAAGCUCUAAAGGACAGGC | 2059 |
| CGGGAAAGCUCUAAAGGACA | 2060 |
| CCGGGAAAGCUCUAAAGGAC | 2061 |
| AGGGUUAAGCUAGAGAGGAA | 2062 |
| UCAGGGUUAAGCUAGAGAGG | 2063 |
| GAUCAGGGUUAAGCUAGAGA | 2064 |
| GGAUCAGGGUUAAGCUAGAG | 2065 |
| AGGAUCAGGGUUAAGCUAGA | 2066 |
| CCCAGGAUCAGGGUUAAGCU | 2067 |
| CAACUCCUCCUGCACCUGGU | 2068 |
| ACAACUCCUCCUGCACCUGG | 2069 |
| GACAAUUCCACAACUCCUCC | 2070 |
| UGACAAUUCCACAACUCCUC | 2071 |
| UUGACAAUUCCACAACUCCU | 2072 |
| CUUGACAAUUCCACAACUCC | 2073 |
| UCCUUGACAAUUCCACAACU | 2074 |
| AUCCUUGACAAUUCCACAAC | 2075 |
| CAUCCUUGACAAUUCCACAA | 2076 |
| ACAUCCUUGACAAUUCCACA | 2077 |
| GACAUCCUUGACAAUUCCAC | 2078 |
| UGACAUCCUUGACAAUUCCA | 2079 |
| UGUGUGACAUCCUUGACAAU | 2080 |
| ACUGUGUGACAUCCUUGACA | 2081 |
| ACUUUCUGUCCACUGUGUGA | 2082 |
| CCUCGCUUGGACUUUCUGUC | 2083 |
| CCCUCGCUUGGACUUUCUGU | 2084 |
| UCCCUCGCUUGGACUUUCUG | 2085 |
| CUCCCUCGCUUGGACUUUCU | 2086 |
| CCUCCCUCGCUUGGACUUUC | 2087 |
| CCCUCCCUCGCUUGGACUUU | 2088 |
| UCCAUCAGCACUGGGUCAGA | 2089 |
| ACCACUAAUCUCCAUCAGCA | 2090 |
| CACCACUAAUCUCCAUCAGC | 2091 |
| CCACCACUAAUCUCCAUCAG | 2092 |
| CCCACCACUAAUCUCCAUCA | 2093 |
| ACCAGACACCCACCACUAAU | 2094 |
| UACCAGACACCCACCACUAA | 2095 |
| CUCAUACCAGACACCCACCA | 2096 |
| CCUCAUACCAGACACCCACC | 2097 |
| UCCUCAUACCAGACACCCAC | 2098 |
| AUCCUCAUACCAGACACCCA | 2099 |
| GAUCCUCAUACCAGACACCC | 2100 |
| AGAUCCUCAUACCAGACACC | 2101 |
| UAGAUCCUCAUACCAGACAC | 2102 |
| GUAGAUCCUCAUACCAGACA | 2103 |
| AGUAGAUCCUCAUACCAGAC | 2104 |
| CAGUAGAUCCUCAUACCAGA | 2105 |
| UGCAGUAGAUCCUCAUACCA | 2106 |
| GUGCAGUAGAUCCUCAUACC | 2107 |
| AGUGCAGUAGAUCCUCAUAC | 2108 |
| ACUCUGUAGGACACCCUUGU | 2109 |
| CACUCUGUAGGACACCCUUG | 2110 |
| CCACUCUGUAGGACACCCUU | 2111 |
| UCCACUCUGUAGGACACCCU | 2112 |
| CUCCACUCUGUAGGACACCC | 2113 |
| ACUCCACUCUGUAGGACACC | 2114 |
| CACUCCACUCUGUAGGACAC | 2115 |
| AGCACUCCACUCUGUAGGAC | 2116 |
| UAUGACAGCACUCCACUCUG | 2117 |
| AUAUGACAGCACUCCACUCU | 2118 |
| UUGCUGUGCUUGGGCCUCUC | 2119 |
| ACGUCAAAGGUGAAUCGGGC | 2120 |
| CACGUCAAAGGUGAAUCGGG | 2121 |
| ACACGUCAAAGGUGAAUCGG | 2122 |
| UACACGUCAAAGGUGAAUCG | 2123 |
| GUACACGUCAAAGGUGAAUC | 2124 |
| GGCUGCCAAAGAGGUCUCGA | 2125 |
| UCAGGCUGCCAAAGAGGUCU | 2126 |
| CAUUCAGGCUGCCAAAGAGG | 2127 |
| GACAUUCAGGCUGCCAAAGA | 2128 |
| UGACAUUCAGGCUGCCAAAG | 2129 |
| CUUUGACAUUCAGGCUGCCA | 2130 |
| GCUUUGACAUUCAGGCUGCC | 2131 |
| CCGUAGAAUGUGGCUUUGAC | 2132 |
| GCCCGUAGAAUGUGGCUUUG | 2133 |
| UAGAGCCCGUAGAAUGUGGC | 2134 |

TABLE 3-continued

| Sequence | SEQ ID NO: |
|---|---|
| GUAGAGCCCGUAGAAUGUGG | 2135 |
| AGUAGAGCCCGUAGAAUGUG | 2136 |
| AGAGUAGAGCCCGUAGAAUG | 2137 |
| UAGAGUAGAGCCCGUAGAAU | 2138 |
| AUAGAGUAGAGCCCGUAGAA | 2139 |
| CAUAGAGUAGAGCCCGUAGA | 2140 |
| UCAUAGAGUAGAGCCCGUAG | 2141 |
| CUCAUAGAGUAGAGCCCGUA | 2142 |
| GAAAGUCACAACUCAUAGAG | 2143 |
| CCUUGAAAGUCACAACUCAU | 2144 |
| AAGUCCUUGAAAGUCACAAC | 2145 |
| CCAAGUCCUUGAAAGUCACA | 2146 |
| UUCUUUGGGCCAAGUCCUUG | 2147 |
| UUUCUUUGGGCCAAGUCCUU | 2148 |
| UUGAUUUCUGACCUGAGUAC | 2149 |
| GUUGAUUUCUGACCUGAGUA | 2150 |
| GGGACUAUCCAACUGUAGGG | 2151 |
| GCAAGAGGACGAAUUAUGGG | 2152 |
| UGCAAGAGGACGAAUUAUGG | 2153 |
| GUGCAAGAGGACGAAUUAUG | 2154 |
| GGUGCAAGAGGACGAAUUAU | 2155 |
| GGGUGCAAGAGGACGAAUUA | 2156 |
| UGGGUGCAAGAGGACGAAUU | 2157 |
| GUGGGUGCAAGAGGACGAAU | 2158 |
| GGUGGGUGCAAGAGGACGAA | 2159 |
| UAGGUGGGUGCAAGAGGACG | 2160 |
| GUAGGUGGGUGCAAGAGGAC | 2161 |
| GGUAGGUGGGUGCAAGAGGA | 2162 |
| CCACAAGCAAGAGCUAACUA | 2163 |
| ACUUCCACAAGCAAGAGCU | 2164 |
| GACUUCCACAAGCAAGAGC | 2165 |
| GGACUUUCCACAAGCAAGAG | 2166 |
| AGGACUUUCCACAAGCAAGA | 2167 |
| GAGGACUUUCCACAAGCAAG | 2168 |
| UGAGGACUUUCCACAAGCAA | 2169 |
| AUGAGGACUUUCCACAAGCA | 2170 |
| GAUGAGGACUUUCCACAAGC | 2171 |
| AGAUGAGGACUUUCCACAAG | 2172 |
| GAGAUGAGGACUUUCCACAA | 2173 |
| GGAGAUGAGGACUUUCCACA | 2174 |
| UGGGAGAUGAGGACUUUCCA | 2175 |
| GCUGGGAGAUGAGGACUUUC | 2176 |
| UCAAGCUGGGAGAUGAGGAC | 2177 |
| AAGCCAUCAAGCUGGGAGAU | 2178 |
| GAAGCCAUCAAGCUGGGAGA | 2179 |
| GGAGGAAGCCAUCAAGCUGG | 2180 |
| GGGAGGAAGCCAUCAAGCUG | 2181 |
| AACUUGGGAGGAAGCCAUCA | 2182 |
| AAACUUGGGAGGAAGCCAUC | 2183 |
| CAGCAGUGUGGAGGUCCAAC | 2184 |
| GCAGCAGUGUGGAGGUCCAA | 2185 |
| UGCAGCAGUGUGGAGGUCCA | 2186 |
| UUGCAGCAGUGUGGAGGUCC | 2187 |
| GGUGGAGGAAAUUCCCAGCA | 2188 |
| ACGAAGGGUGGAGGAAAUUC | 2189 |
| GACGAAGGGUGGAGGAAAUU | 2190 |
| AUGACGAAGGGUGGAGGAAA | 2191 |
| CAUGACGAAGGGUGGAGGAA | 2192 |
| GCAUGACGAAGGGUGGAGGA | 2193 |
| UGCAUGACGAAGGGUGGAGG | 2194 |
| CUGCAUGACGAAGGGUGGAG | 2195 |
| ACUGCAUGACGAAGGGUGGA | 2196 |
| CACUGCAUGACGAAGGGUGG | 2197 |
| CCACUGCAUGACGAAGGGUG | 2198 |
| UCCACUGCAUGACGAAGGGU | 2199 |
| CUCCACUGCAUGACGAAGGG | 2200 |
| CCUCCACUGCAUGACGAAGG | 2201 |
| CCCUCCACUGCAUGACGAAG | 2202 |
| CUUAGUAGGAAUGGAGGCGG | 2203 |
| CCUUAGUAGGAAUGGAGGCG | 2204 |
| CCCUUAGUAGGAAUGGAGGC | 2205 |
| UCGGUUGGAAUGAUUCUGGG | 2206 |
| GUCGGUUGGAAUGAUUCUGG | 2207 |
| GGUCGGUUGGAAUGAUUCUG | 2208 |
| GGGUCGGUUGGAAUGAUUCU | 2209 |
| UGGGUCGGUUGGAAUGAUUC | 2210 |

TABLE 3-continued

| Sequence | SEQ ID NO: |
|---|---|
| GUGGGUCGGUUGGAAUGAUU | 2211 |
| AGUGGGUCGGUUGGAAUGAU | 2212 |
| CAGUGGGUCGGUUGGAAUGA | 2213 |
| GCAGUGGGUCGGUUGGAAUG | 2214 |
| UGCAGUGGGUCGGUUGGAAU | 2215 |
| UUGCAGUGGGUCGGUUGGAA | 2216 |
| UUUGCAGUGGGUCGGUUGGA | 2217 |
| CUUUGCAGUGGGUCGGUUGG | 2218 |
| UCUUUGCAGUGGGUCGGUUG | 2219 |
| UAGUCUUUGCAGUGGGUCGG | 2220 |
| AUAGUCUUUGCAGUGGGUCG | 2221 |
| CUGUCAUAGUCUUUGCAGUG | 2222 |
| UGCUGUCAUAGUCUUUGCAG | 2223 |
| UCUAGCCUGUACUGUCUGCA | 2224 |
| AUCUAGCCUGUACUGUCUGC | 2225 |
| UAUCUAGCCUGUACUGUCUG | 2226 |
| UUAUCUAGCCUGUACUGUCU | 2227 |
| GUUAUCUAGCCUGUACUGUC | 2228 |
| GGUUAUCUAGCCUGUACUGU | 2229 |
| GGGUUAUCUAGCCUGUACUG | 2230 |
| UGGGUUAUCUAGCCUGUACU | 2231 |
| GUGGGUUAUCUAGCCUGUAC | 2232 |
| GGUGGGUUAUCUAGCCUGUA | 2233 |
| GGGUGGGUUAUCUAGCCUGU | 2234 |
| UGGGUGGGUUAUCUAGCCUG | 2235 |
| UUGGGUGGGUUAUCUAGCCU | 2236 |
| AUUGGGUGGGUUAUCUAGCC | 2237 |
| AAUUGGGUGGGUUAUCUAGC | 2238 |
| AAAUUGGGUGGGUUAUCUAG | 2239 |
| GGAAAUUGGGUGGGUUAUCU | 2240 |
| GGGAAAUUGGGUGGGUUAUC | 2241 |
| GAAAGGUUCUGUCACGAGGG | 2242 |
| GCUGAAAGGUUCUGUCACGA | 2243 |
| UGCUGAAAGGUUCUGUCACG | 2244 |
| GGCGUUAUGCUGAAAGGUUC | 2245 |
| AGGCGUUAUGCUGAAAGGUU | 2246 |
| GAGGCGUUAUGCUGAAAGGU | 2247 |
| UGAGGCGUUAUGCUGAAAGG | 2248 |

TABLE 3-continued

| Sequence | SEQ ID NO: |
|---|---|
| GUGAGGCGUUAUGCUGAAAG | 2249 |
| AUGUGAGGCGUUAUGCUGAA | 2250 |
| GAUGUGAGGCGUUAUGCUGA | 2251 |
| GGAUGUGAGGCGUUAUGCUG | 2252 |
| GGGAUGUGAGGCGUUAUGCU | 2253 |
| CUUGGGAUGUGAGGCGUUAU | 2254 |
| AGACUUGGGAUGUGAGGCGU | 2255 |
| UAGACUUGGGAUGUGAGGCG | 2256 |
| AUAGACUUGGGAUGUGAGGC | 2257 |
| UAUAGACUUGGGAUGUGAGG | 2258 |
| GGGUAUAGACUUGGGAUGUG | 2259 |
| AGGGUAUAGACUUGGGAUGU | 2260 |
| AAGGUGGCUAGGAAAGAACA | 2261 |
| AAAGGUGGCUAGGAAAGAAC | 2262 |
| GAAAGGUGGCUAGGAAAGAA | 2263 |
| ACAUCUUGAUCUUGGCCUUU | 2264 |
| GGCUGGGAUCAAGAUGCCUG | 2265 |
| GUCAGGCUGGGAUCAAGAUG | 2266 |
| AGUCAGGCUGGGAUCAAGAU | 2267 |
| CAGUCAGGCUGGGAUCAAGA | 2268 |
| AGCAGUCAGGCUGGGAUCAA | 2269 |
| GAUGUAGCAGCAGUCAGGCU | 2270 |
| GGAUUAGAUGUAGCAGCAGU | 2271 |
| GGGAUUAGAUGUAGCAGCAG | 2272 |
| GACAGGAGGCAUUGGUAGGG | 2273 |
| UUAGGGACAGGAGGCAUUGG | 2274 |
| UUUAGGGACAGGAGGCAUUG | 2275 |
| GAGUUUAGGGACAGGAGGCA | 2276 |
| GGAGUUUAGGGACAGGAGGC | 2277 |
| GCUGUCAUCAGUAUGCUGGG | 2278 |
| GGCUGUCAUCAGUAUGCUGG | 2279 |
| GGGCUGUCAUCAGUAUGCUG | 2280 |
| AGGGCUGUCAUCAGUAUGCU | 2281 |
| AGAGAGGGCUGUCAUCAGUA | 2282 |
| CAGAGAGGGCUGUCAUCAGU | 2283 |
| UCAGAGAGGGCUGUCAUCAG | 2284 |
| GUCAGAGAGGGCUGUCAUCA | 2285 |

TABLE 3-continued

| Sequence | SEQ ID NO: |
|---|---|
| GGUAAAGUCAGAGAGGGCUG | 2286 |
| GGGAAGGGUAUGAAGACAGA | 2287 |

In some embodiments, the antisense nucleic acid molecules targeted to Transcript C comprise or consist of the nucleotide sequences shown in Table 4.

TABLE 4

| Sequence | SEQ ID NO: |
|---|---|
| GUUUCUGGCUCUCAGGCUCU | 2288 |
| GGUUUCUGGCUCUCAGGCUC | 2289 |
| CGGUUUCUGGCUCUCAGGCU | 2290 |
| GGACGGUUUCUGGCUCUCAG | 2291 |
| GGGACGGUUUCUGGCUCUCA | 2292 |
| UGAAAUGUGACUUCUGGUGU | 2293 |
| GGGAACCAUGUAAAAGGAUG | 2294 |
| GUGAGGGUAGAUGGGAACCA | 2295 |
| UUGUGAGGGUAGAUGGGAAC | 2296 |
| GUUGUGAGGGUAGAUGGGAA | 2297 |
| UGUUGUGAGGGUAGAUGGGA | 2298 |
| AUGUGUGUCUUUGGUGAUGA | 2299 |
| GGAGCUUGUAUGUGUGUCUU | 2300 |
| UUGGAGCUUGUAUGUGUGUC | 2301 |
| AUUGGAGCUUGUAUGUGUGU | 2302 |
| CAUUGGAGCUUGUAUGUGUG | 2303 |
| CCAUUGGAGCUUGUAUGUGU | 2304 |
| GCCAUUGGAGCUUGUAUGUG | 2305 |
| AGCCAUUGGAGCUUGUAUGU | 2306 |
| CUGGAGGAAGAAUUGCCUGG | 2307 |
| GUCCUGGAGGAAGAAUUGCC | 2308 |
| GCCAGUAAGAAGGGCAAAGU | 2309 |
| GGCCAGUAAGAAGGGCAAAG | 2310 |
| GGAAUGAGUCAAGCCUGGAC | 2311 |
| GGGAAUGAGUCAAGCCUGGA | 2312 |
| GUGGGAAUGAGUCAAGCCUG | 2313 |
| AAGGUGGGAAUGAGUCAAGC | 2314 |
| UCUCAGCCCAGGACAAGGUG | 2315 |
| AUCUCAGCCCAGGACAAGGU | 2316 |
| GCUGGGUGGUUCUCUCCUGU | 2317 |

TABLE 4-continued

| Sequence | SEQ ID NO: |
|---|---|
| UUCUGGGCUGGGUGGUUCUC | 2318 |
| GAACUUCUGGGCUGGGUGGU | 2319 |
| CGGAGAGUUCCUUCCCUGGA | 2320 |
| ACCGGAGAGUUCCUUCCCUG | 2321 |
| GACCGGAGAGUUCCUUCCCU | 2322 |
| UGGACCGGAGAGUUCCUUCC | 2323 |
| GUGGACCGGAGAGUUCCUUC | 2324 |
| GGUGGACCGGAGAGUUCCUU | 2325 |
| UGGUGGACCGGAGAGUUCCU | 2326 |
| AUGGUGGACCGGAGAGUUCC | 2327 |
| CAUGGUGGACCGGAGAGUUC | 2328 |
| GAGCUGAGAGGUACUCCAUG | 2329 |
| AGAGCUGAGAGGUACUCCAU | 2330 |
| CAGAGCUGAGAGGUACUCCA | 2331 |
| UUCAGAGCUGAGAGGUACUC | 2332 |
| GGUUCAGAGCUGAGAGGUAC | 2333 |
| GGGUUCAGAGCUGAGAGGUA | 2334 |
| CACCUGAGUAAGUCACUGGG | 2335 |
| UCACCUGAGUAAGUCACUGG | 2336 |
| GUCACCUGAGUAAGUCACUG | 2337 |
| AGUCACCUGAGUAAGUCACU | 2338 |
| CAGUCACCUGAGUAAGUCAC | 2339 |
| GCAGUCACCUGAGUAAGUCA | 2340 |
| UUAGCAGUCACCUGAGUAAG | 2341 |
| GUUAGCAGUCACCUGAGUAA | 2342 |
| GGUUAGCAGUCACCUGAGUA | 2343 |
| GGGUUAGCAGUCACCUGAGU | 2344 |
| AGGGUUAGCAGUCACCUGAG | 2345 |
| GAGGGUUAGCAGUCACCUGA | 2346 |
| GGAGGGUUAGCAGUCACCUG | 2347 |
| CGGAGGGUUAGCAGUCACCU | 2348 |
| AGCGGAGGGUUAGCAGUCAC | 2349 |
| GAGCGGAGGGUUAGCAGUCA | 2350 |
| AGAGCGGAGGGUUAGCAGUC | 2351 |
| UAGAGCGGAGGGUUAGCAGU | 2352 |
| GUAGAGCGGAGGGUUAGCAG | 2353 |
| GGUAGAGCGGAGGGUUAGCA | 2354 |
| AGGGUAGAGCGGAGGGUUAG | 2355 |

TABLE 4-continued

| Sequence | SEQ ID NO: |
|---|---|
| GAGGGUAGAGCGGAGGGUUA | 2356 |
| AUUGUUGCCCUGCCUAUAUC | 2357 |
| AGUAUUGUUGCCCUGCCUAU | 2358 |
| GAGUAUUGUUGCCCUGCCUA | 2359 |
| GGAGUAUUGUUGCCCUGCCU | 2360 |
| UGGAGUAUUGUUGCCCUGCC | 2361 |
| GUGGAGUAUUGUUGCCCUGC | 2362 |
| AGUGGAGUAUUGUUGCCCUG | 2363 |
| GAGUGGAGUAUUGUUGCCCU | 2364 |
| UGAGUGGAGUAUUGUUGCCC | 2365 |
| CUGAGUGGAGUAUUGUUGCC | 2366 |
| GCUGAGUGGAGUAUUGUUGC | 2367 |
| GGCUGAGUGGAGUAUUGUUG | 2368 |
| GGGCUGAGUGGAGUAUUGUU | 2369 |
| GGUACUGGUUAGUCUCCUAG | 2370 |
| GGGUACUGGUUAGUCUCCUA | 2371 |
| UUGACAAGCCCACUGUGGAG | 2372 |
| UGGCUCAGGAGCUUGACAAG | 2373 |
| GGUGGCUCAGGAGCUUGACA | 2374 |
| UAGGGAUGAGGGAGAGACCA | 2375 |
| UCGAUUAGGGAUGAGGGAGA | 2376 |
| UAGAGGGCUAGGGAGGGAGA | 2377 |
| GUAGAGUGGCUAGAGGGCUA | 2378 |
| GGUAGAGUGGCUAGAGGGCU | 2379 |
| UGAGGGUAGAGUGGCUAGAG | 2380 |
| GAUGAGGGUAGAGUGGCUAG | 2381 |
| CAUGAUGAGGGUAGAGUGGC | 2382 |
| GCAUGAUGAGGGUAGAGUGG | 2383 |
| GGGCAUGAUGAGGGUAGAGU | 2384 |
| GGUAGUUGAGAAGAAAAGUC | 2385 |
| CCAAACUCCGAGCUUAUAUU | 2386 |
| UCCAAACUCCGAGCUUAUAU | 2387 |
| GUCCAAACUCCGAGCUUAUA | 2388 |
| CGUCCAAACUCCGAGCUUAU | 2389 |
| CCGUCCAAACUCCGAGCUUA | 2390 |
| UCCGUCCAAACUCCGAGCUU | 2391 |
| CUCCGUCCAAACUCCGAGCU | 2392 |
| ACCCUCCGUCCAAACUCCGA | 2393 |
| AGACCCUCCGUCCAAACUCC | 2394 |
| CAGACCCUCCGUCCAAACUC | 2395 |
| UCCAGACCCUCCGUCCAAAC | 2396 |
| GUCCAGACCCUCCGUCCAAA | 2397 |
| AGACACGGAAAGGUCGCUGG | 2398 |
| CAGACACGGAAAGGUCGCUG | 2399 |
| ACAGACACGGAAAGGUCGCU | 2400 |
| CACAGACACGGAAAGGUCGC | 2401 |
| UCACAGACACGGAAAGGUCG | 2402 |
| AUCACAGACACGGAAAGGUC | 2403 |
| GAUCACAGACACGGAAAGGU | 2404 |
| UUGGCCUACUUACUUUGGCU | 2405 |
| CUUGGCCUACUUACUUUGGC | 2406 |
| ACUUGGCCUACUUACUUUGG | 2407 |
| GAGGAACUUGGCCUACUUAC | 2408 |
| CGAGGAACUUGGCCUACUUA | 2409 |
| CCGAGGAACUUGGCCUACUU | 2410 |
| ACCGAGGAACUUGGCCUACU | 2411 |
| AACCGAGGAACUUGGCCUAC | 2412 |
| GAACCGAGGAACUUGGCCUA | 2413 |
| GGAACCGAGGAACUUGGCCU | 2414 |
| AGGAACCGAGGAACUUGGCC | 2415 |
| UAGGAACCGAGGAACUUGGC | 2416 |
| AUAGGAACCGAGGAACUUGG | 2417 |
| UAUAGGAACCGAGGAACUUG | 2418 |
| AUCACAAGUUGCCACUGUUG | 2419 |
| CAUCACAAGUUGCCACUGUU | 2420 |
| AUCAUCACAAGUUGCCACUG | 2421 |
| CAUCAUCACAAGUUGCCACU | 2422 |
| CUGCUCCAUCAUCACAAGUU | 2423 |
| UCUGCUCCAUCAUCACAAGU | 2424 |
| CCCUCUGCUCCAUCAUCACA | 2425 |
| UCAGCCCUCUGCUCCAUCAU | 2426 |
| UGACUUCAGCCCUCUGCUCC | 2427 |
| GUGACUUCAGCCCUCUGCUC | 2428 |
| UGUGACUUCAGCCCUCUGCU | 2429 |
| GUGUGACUUCAGCCCUCUGC | 2430 |
| UGUGUGACUUCAGCCCUCUG | 2431 |

TABLE 4-continued

| Sequence | SEQ ID NO: |
|---|---|
| GCCCACUCCGCUGCUUUUAG | 2432 |
| GGCCCACUCCGCUGCUUUUA | 2433 |
| AGGCCCACUCCGCUGCUUUU | 2434 |
| UAGGCCCACUCCGCUGCUUU | 2435 |
| UUAGGCCCACUCCGCUGCUU | 2436 |
| AUUAGGCCCACUCCGCUGCU | 2437 |
| UCAUUAGGCCCACUCCGCUG | 2438 |
| CUCAUUAGGCCCACUCCGCU | 2439 |
| AGCUCAUUAGGCCCACUCCG | 2440 |
| CUCCCAUAGAAAAGCUCACU | 2441 |
| GCUCCCAUAGAAAAGCUCAC | 2442 |
| UGCUCCCAUAGAAAAGCUCA | 2443 |
| CUGCUCCCAUAGAAAAGCUC | 2444 |
| CCUGCUCCCAUAGAAAAGCU | 2445 |
| UCCCUAUCUCCUGCUAACCC | 2446 |
| CCUCGAACUCUCCCUAUCUC | 2447 |
| CCCUCGAACUCUCCCUAUCU | 2448 |
| UCCCUCGAACUCUCCCUAUC | 2449 |
| GUCCCUCGAACUCUCCCUAU | 2450 |
| CUUUCCAUACUAGCUUCUGA | 2451 |
| CCUUUCCAUACUAGCUUCUG | 2452 |
| ACCUUUCCAUACUAGCUUCU | 2453 |
| CACACAAAUCACCUUUCCAU | 2454 |
| GUCACACAAAUCACCUUUCC | 2455 |
| UGUCACACAAAUCACCUUUC | 2456 |
| UUUGACAGGCAGGAAGUGGC | 2457 |
| GGUUUGACAGGCAGGAAGUG | 2458 |
| AGGUUUGACAGGCAGGAAGU | 2459 |
| AAGGUUUGACAGGCAGGAAG | 2460 |
| AACUUCCCAAGGUUUGACAG | 2461 |
| CAACUUCCCAAGGUUUGACA | 2462 |
| GAACAACUUCCCAAGGUUUG | 2463 |
| UGAACAACUUCCCAAGGUUU | 2464 |
| GUAGGUUGAACAACUUCCCA | 2465 |
| GGUAGGUUGAACAACUUCCC | 2466 |
| UGGUAGGUUGAACAACUUCC | 2467 |
| GGUUUUGGUAGGUUGAACAA | 2468 |
| UGAGGUUUUGGUAGGUUGAA | 2469 |
| CUGAGGUUUUGGUAGGUUGA | 2470 |
| CCUACAUUAUCCUCUUACUC | 2471 |
| GGACUUUACCUACAUUAUCC | 2472 |
| GUAUGAGGACUUUACCUACA | 2473 |
| GCCAGGUAUGAGGACUUUAC | 2474 |
| UGCCAGGUAUGAGGACUUUA | 2475 |
| GUGCCAGGUAUGAGGACUUU | 2476 |
| CUGUGCCAGGUAUGAGGACU | 2477 |
| UCUGUGCCAGGUAUGAGGAC | 2478 |
| CCUCAAGAGUUCUCCAGAAG | 2479 |
| CCCUCAAGAGUUCUCCAGAA | 2480 |
| ACCCUCAAGAGUUCUCCAGA | 2481 |
| ACACCCUCAAGAGUUCUCCA | 2482 |
| CACACCCUCAAGAGUUCUCC | 2483 |
| CCACACCCUCAAGAGUUCUC | 2484 |
| CCCACACCCUCAAGAGUUCU | 2485 |
| UUCCCACACCCUCAAGAGUU | 2486 |
| CAAUGCUGCACCCACUUCC | 2487 |
| UACAAUGCUGCACCUCACUU | 2488 |
| CUACAAUGCUGCACCUCACU | 2489 |
| UCUACAAUGCUGCACCUCAC | 2490 |
| AUCUACAAUGCUGCACCUCA | 2491 |
| UAUCUACAAUGCUGCACCUC | 2492 |
| CUUAUCUACAAUGCUGCACC | 2493 |
| GUCUUAUCUACAAUGCUGCA | 2494 |
| UGUCUUAUCUACAAUGCUGC | 2495 |
| CUGUCUUAUCUACAAUGCUG | 2496 |
| CACCCUUCUGUCUUAUCUAC | 2497 |
| UCCACCCUUCUGUCUUAUCU | 2498 |
| GUCCACCCUUCUGUCUUAUC | 2499 |
| AGUCCACCCUUCUGUCUUAU | 2500 |
| AAGUCCACCCUUCUGUCUUA | 2501 |
| GAAAGCAAGCCAGGUUCUCA | 2502 |
| GGAAAGCAAGCCAGGUUCUC | 2503 |
| GGAAUUGGAAAGCAAGCCAG | 2504 |
| ACCAUGUCAUUGGCAUCUCC | 2505 |
| UACCAUGUCAUUGGCAUCUC | 2506 |
| CCUACCAUGUCAUUGGCAUC | 2507 |

TABLE 4-continued

| Sequence | SEQ ID NO: |
|---|---|
| UCCUACCAUGUCAUUGGCAU | 2508 |
| CUCCUACCAUGUCAUUGGCA | 2509 |
| GCUCCUACCAUGUCAUUGGC | 2510 |
| UGCUCCUACCAUGUCAUUGG | 2511 |
| UCUUUGCUCCUACCAUGUCA | 2512 |
| CCUCUUUGCUCCUACCAUGU | 2513 |
| UUCCUCUUUGCUCCUACCAU | 2514 |
| UCUCCGUGUUCUUCAGUUUU | 2515 |
| CUCUCCGUGUUCUUCAGUUU | 2516 |
| AGCUCUCCGUGUUCUUCAGU | 2517 |
| UGCAGCUCUCCGUGUUCUUC | 2518 |
| GGUUGCAGCUCUCCGUGUUC | 2519 |
| AGGUUGCAGCUCUCCGUGUU | 2520 |
| AAAGGUUGCAGCUCUCCGUG | 2521 |
| UAAAGGUUGCAGCUCUCCGU | 2522 |
| CUAAAGGUUGCAGCUCUCCG | 2523 |
| CCUAAAGGUUGCAGCUCUCC | 2524 |
| UCCUAAAGGUUGCAGCUCUC | 2525 |
| CUCCUAAAGGUUGCAGCUCU | 2526 |
| CCUCCUAAAGGUUGCAGCUC | 2527 |
| GCACUUUGAUACCUCCUAAA | 2528 |
| GGCACUUUGAUACCUCCUAA | 2529 |
| GAUGUCCCACUUUGACUUUC | 2530 |
| UCGAUGUCCCACUUUGACUU | 2531 |
| GUCGAUGUCCCACUUUGACU | 2532 |
| GGUCGAUGUCCCACUUUGAC | 2533 |
| UGGUCGAUGUCCCACUUUGA | 2534 |
| UUGGUCGAUGUCCCACUUUG | 2535 |
| AUUGGUCGAUGUCCCACUUU | 2536 |
| CAUUGGUCGAUGUCCCACUU | 2537 |
| AACAUCCAUCAGUUGGCUCU | 2538 |
| CUGCCCAACAUCCAUCAGUU | 2539 |
| AGCUGCCCAACAUCCAUCAG | 2540 |
| UAGCUGCCCAACAUCCAUCA | 2541 |
| UUAGCUGCCCAACAUCCAUC | 2542 |
| UUUAGCUGCCCAACAUCCAU | 2543 |
| CUUUAGCUGCCCAACAUCCA | 2544 |
| CCUCUUUAGCUGCCCAACAU | 2545 |
| CCCUCUUUAGCUGCCCAACA | 2546 |
| UCCCUCUUUAGCUGCCCAAC | 2547 |
| UUCCCUCUUUAGCUGCCCAA | 2548 |
| CCUUCCCUCUUUAGCUGCCC | 2549 |
| CCCUUCCCUCUUUAGCUGCC | 2550 |
| GCAGGUCUUAUCCCAUGCCC | 2551 |
| GGGCAGGUCUUAUCCCAUGC | 2552 |
| AGGGCAGGUCUUAUCCCAUG | 2553 |
| AAGGGCAGGUCUUAUCCCAU | 2554 |
| GAAGGGCAGGUCUUAUCCCA | 2555 |
| AGAAGGGCAGGUCUUAUCCC | 2556 |
| CCAAUGGCAAGAAGCAAGAA | 2557 |
| CCCAAUGGCAAGAAGCAAGA | 2558 |
| GCCCAAUGGCAAGAAGCAAG | 2559 |
| UCCAAUGCCUGCCCAAUGGC | 2560 |
| CUCCAAUGCCUGCCCAAUGG | 2561 |
| UCUCCAAUGCCUGCCCAAUG | 2562 |
| GGUCUCCAAUGCCUGCCCAA | 2563 |
| UAGGGUCUCCAAUGCCUGCC | 2564 |
| GUAGGGUCUCCAAUGCCUGC | 2565 |
| AGUAGGGUCUCCAAUGCCUG | 2566 |
| CAGUAGGGUCUCCAAUGCCU | 2567 |
| GCAGUAGGGUCUCCAAUGCC | 2568 |
| AGCAGUAGGGUCUCCAAUGC | 2569 |
| CAGCAGUAGGGUCUCCAAUG | 2570 |
| UCAGCAGUAGGGUCUCCAAU | 2571 |
| AUUCAGCAGUAGGGUCUCCA | 2572 |
| CAUUCAGCAGUAGGGUCUCC | 2573 |
| CCAUUCAGCAGUAGGGUCUC | 2574 |
| UCCAUUCAGCAGUAGGGUCU | 2575 |
| ACUCCAUUCAGCAGUAGGGU | 2576 |
| CACUCCAUUCAGCAGUAGGG | 2577 |
| GCACUCCAUUCAGCAGUAGG | 2578 |
| AGCACUCCAUUCAGCAGUAG | 2579 |
| UAGCACUCCAUUCAGCAGUA | 2580 |
| GGUUAGCACUCCAUUCAGCA | 2581 |
| GGUUAGCACUCCAUUCAGCA | 2582 |
| GGGUUAGCACUCCAUUCAGC | 2583 |

TABLE 4-continued

| Sequence | SEQ ID NO: |
|---|---|
| CAGGGUUAGCACUCCAUUCA | 2584 |
| CCAGGGUUAGCACUCCAUUC | 2585 |
| ACCAGGGUUAGCACUCCAUU | 2586 |
| CACCAGGGUUAGCACUCCAU | 2587 |
| GCACCAGGGUUAGCACUCCA | 2588 |
| AGCACCAGGGUUAGCACUCC | 2589 |
| UAGCACCAGGGUUAGCACUC | 2590 |
| CUAGCACCAGGGUUAGCACU | 2591 |
| UCUAGCACCAGGGUUAGCAC | 2592 |
| CUCUAGCACCAGGGUUAGCA | 2593 |
| CCUCUAGCACCAGGGUUAGC | 2594 |
| UCCUCUAGCACCAGGGUUAG | 2595 |
| CUCCUCUAGCACCAGGGUUA | 2596 |
| CCUCCUCUAGCACCAGGGUU | 2597 |
| UCCUCCUCUAGCACCAGGGU | 2598 |
| GUUCCAUCCUCCUCUAGCAC | 2599 |
| AAGUCCUCACUGUCCACUGC | 2600 |
| GAAGUCCUCACUGUCCACUG | 2601 |
| AGAAGUCCUCACUGUCCACU | 2602 |
| AAGAAGUCCUCACUGUCCAC | 2603 |
| GAAGAAGUCCUCACUGUCCA | 2604 |
| GGAAGAAGUCCUCACUGUCC | 2605 |
| UGGAAGAAGUCCUCACUGUC | 2606 |
| CUGGAAGAAGUCCUCACUGU | 2607 |
| AGCUGGAAGAAGUCCUCACU | 2608 |
| ACUGCAACACCAUCAGGCAC | 2609 |
| GACUGCAACACCAUCAGGCA | 2610 |
| AGACUGCAACACCAUCAGGC | 2611 |
| CAGACUGCAACACCAUCAGG | 2612 |
| CCAGACUGCAACACCAUCAG | 2613 |
| GACCAGACUGCAACACCAUC | 2614 |
| CUCUGACCAGACUGCAACAC | 2615 |
| AGCUCUGACCAGACUGCAAC | 2616 |
| CCAGCUCUGACCAGACUGCA | 2617 |
| UGUAGGGCUCCAGCUCUGAC | 2618 |
| CUUGUAGGGCUCCAGCUCUG | 2619 |
| CCUUGUAGGGCUCCAGCUCU | 2620 |
| ACAGGCAUUGGAAGCAGCCC | 2621 |
| GACAGGCAUUGGAAGCAGCC | 2622 |
| AAGGACAGGCAUUGGAAGCA | 2623 |
| AAAGGACAGGCAUUGGAAGC | 2624 |
| UAAAGGACAGGCAUUGGAAG | 2625 |
| CUAAAGGACAGGCAUUGGAA | 2626 |
| GCUCUAAAGGACAGGCAUUG | 2627 |
| AGCUCUAAAGGACAGGCAUU | 2628 |
| AAGCUCUAAAGGACAGGCAU | 2629 |
| AAAGCUCUAAAGGACAGGCA | 2630 |
| GAAAGCUCUAAAGGACAGGC | 2631 |
| CGGGAAAGCUCUAAAGGACA | 2632 |
| CCGGGAAAGCUCUAAAGGAC | 2633 |
| AGGGUUAAGCUAGAGAGGAA | 2634 |
| UCAGGGUUAAGCUAGAGAGG | 2635 |
| GAUCAGGGUUAAGCUAGAGA | 2636 |
| GGAUCAGGGUUAAGCUAGAG | 2637 |
| AGGAUCAGGGUUAAGCUAGA | 2638 |
| CCCAGGAUCAGGGUUAAGCU | 2639 |
| CAACUCCUCCUGCACCUGGU | 2640 |
| ACAACUCCUCCUGCACCUGG | 2641 |
| GACAAUUCCACAACUCCUCC | 2642 |
| UGACAAUUCCACAACUCCUC | 2643 |
| UUGACAAUUCCACAACUCCU | 2644 |
| CUUGACAAUUCCACAACUCC | 2645 |
| UCCUUGACAAUUCCACAACU | 2646 |
| AUCCUUGACAAUUCCACAAC | 2647 |
| CAUCCUUGACAAUUCCACAA | 2648 |
| ACAUCCUUGACAAUUCCACA | 2649 |
| GACAUCCUUGACAAUUCCAC | 2650 |
| UGACAUCCUUGACAAUUCCA | 2651 |
| UGUGUGACAUCCUUGACAAU | 2652 |
| ACUGUGUGACAUCCUUGACA | 2653 |
| ACUUUCUGUCCACUGUGUGA | 2654 |
| CCUCGCUUGGACUUUCUGUC | 2655 |
| CCCUCGCUUGGACUUUCUGU | 2656 |
| UCCCUCGCUUGGACUUUCUG | 2657 |
| CUCCCUCGCUUGGACUUUCU | 2658 |
| CCUCCCUCGCUUGGACUUUC | 2659 |

TABLE 4-continued

| Sequence | SEQ ID NO: |
|---|---|
| CCCUCCCUCGCUUGGACUUU | 2660 |
| UCCAUCAGCACUGGGUCAGA | 2661 |
| ACCACUAAUCUCCAUCAGCA | 2662 |
| CACCACUAAUCUCCAUCAGC | 2663 |
| CCACCACUAAUCUCCAUCAG | 2664 |
| CCCACCACUAAUCUCCAUCA | 2665 |
| ACCAGACACCCACCACUAAU | 2666 |
| UACCAGACACCCACCACUAA | 2667 |
| CUCAUACCAGACACCCACCA | 2668 |
| CCUCAUACCAGACACCCACC | 2669 |
| UCCUCAUACCAGACACCCAC | 2670 |
| AUCCUCAUACCAGACACCCA | 2671 |
| GAUCCUCAUACCAGACACCC | 2672 |
| AGAUCCUCAUACCAGACACC | 2673 |
| UAGAUCCUCAUACCAGACAC | 2674 |
| GUAGAUCCUCAUACCAGACA | 2675 |
| AGUAGAUCCUCAUACCAGAC | 2676 |
| CAGUAGAUCCUCAUACCAGA | 2677 |
| UGCAGUAGAUCCUCAUACCA | 2678 |
| GUGCAGUAGAUCCUCAUACC | 2679 |
| AGUGCAGUAGAUCCUCAUAC | 2680 |
| ACUCUGUAGGACACCCUUGU | 2681 |
| CACUCUGUAGGACACCCUUG | 2682 |
| CCACUCUGUAGGACACCCUU | 2683 |
| UCCACUCUGUAGGACACCCU | 2684 |
| CUCCACUCUGUAGGACACCC | 2685 |
| ACUCCACUCUGUAGGACACC | 2686 |
| CACUCCACUCUGUAGGACAC | 2687 |
| AGCACUCCACUCUGUAGGAC | 2688 |
| UAUGACAGCACUCCACUCUG | 2689 |
| AUAUGACAGCACUCCACUCU | 2690 |
| UUGCUGUGCUUGGGCCUCUC | 2691 |
| ACGUCAAAGGUGAAUCGGGC | 2692 |
| CACGUCAAAGGUGAAUCGGG | 2693 |
| ACACGUCAAAGGUGAAUCGG | 2694 |
| UACACGUCAAAGGUGAAUCG | 2695 |
| GUACACGUCAAAGGUGAAUC | 2696 |
| GGCUGCCAAAGAGGUCUCGA | 2697 |
| UCAGGCUGCCAAAGAGGUCU | 2698 |
| CAUUCAGGCUGCCAAAGAGG | 2699 |
| GACAUUCAGGCUGCCAAAGA | 2700 |
| UGACAUUCAGGCUGCCAAAG | 2701 |
| CUUUGACAUUCAGGCUGCCA | 2702 |
| GCUUUGACAUUCAGGCUGCC | 2703 |
| CCGUAGAAUGUGGCUUUGAC | 2704 |
| GCCCGUAGAAUGUGGCUUUG | 2705 |
| UAGAGCCCGUAGAAUGUGGC | 2706 |
| GUAGAGCCCGUAGAAUGUGG | 2707 |
| AGUAGAGCCCGUAGAAUGUG | 2708 |
| AGAGUAGAGCCCGUAGAAUG | 2709 |
| UAGAGUAGAGCCCGUAGAAU | 2710 |
| AUAGAGUAGAGCCCGUAGAA | 2711 |
| CAUAGAGUAGAGCCCGUAGA | 2712 |
| UCAUAGAGUAGAGCCCGUAG | 2713 |
| CUCAUAGAGUAGAGCCCGUA | 2714 |
| GAAAGUCACAACUCAUAGAG | 2715 |
| CCUUGAAAGUCACAACUCAU | 2716 |
| AAGUCCUUGAAAGUCACAAC | 2717 |
| CCAAGUCCUUGAAAGUCACA | 2718 |
| UUCUUUGGGCCAAGUCCUUG | 2719 |
| UUUCUUUGGGCCAAGUCCUU | 2720 |
| UUGAUUUCUGACCUGAGUAC | 2721 |
| GUUGAUUUCUGACCUGAGUA | 2722 |
| GGGACUAUCCAACUGUAGGG | 2723 |
| GCAAGAGGACGAAUUAUGGG | 2724 |
| UGCAAGAGGACGAAUUAUGG | 2725 |
| GUGCAAGAGGACGAAUUAUG | 2726 |
| GGUGCAAGAGGACGAAUUAU | 2727 |
| GGGUGCAAGAGGACGAAUUA | 2728 |
| UGGGUGCAAGAGGACGAAUU | 2729 |
| GUGGGUGCAAGAGGACGAAU | 2730 |
| GGUGGGUGCAAGAGGACGAA | 2731 |
| UAGGUGGGUGCAAGAGGACG | 2732 |
| GUAGGUGGGUGCAAGAGGAC | 2733 |
| GGUAGGUGGGUGCAAGAGGA | 2734 |
| CCACAAGCAAGAGCUAACUA | 2735 |

TABLE 4-continued

| Sequence | SEQ ID NO: |
|---|---|
| ACUUUCCACAAGCAAGAGCU | 2736 |
| GACUUUCCACAAGCAAGAGC | 2737 |
| GGACUUUCCACAAGCAAGAG | 2738 |
| AGGACUUUCCACAAGCAAGA | 2739 |
| GAGGACUUUCCACAAGCAAG | 2740 |
| UGAGGACUUUCCACAAGCAA | 2741 |
| AUGAGGACUUUCCACAAGCA | 2742 |
| GAUGAGGACUUUCCACAAGC | 2743 |
| AGAUGAGGACUUUCCACAAG | 2744 |
| GAGAUGAGGACUUUCCACAA | 2745 |
| GGAGAUGAGGACUUUCCACA | 2746 |
| UGGGAGAUGAGGACUUUCCA | 2747 |
| GCUGGGAGAUGAGGACUUUC | 2748 |
| UCAAGCUGGGAGAUGAGGAC | 2749 |
| AAGCCAUCAAGCUGGGAGAU | 2750 |
| GAAGCCAUCAAGCUGGGAGA | 2751 |
| GGAGGAAGCCAUCAAGCUGG | 2752 |
| GGGAGGAAGCCAUCAAGCUG | 2753 |
| AACUUGGGAGGAAGCCAUCA | 2754 |
| AAACUUGGGAGGAAGCCAUC | 2755 |
| CAGCAGUGUGGAGGUCCAAC | 2756 |
| GCAGCAGUGUGGAGGUCCAA | 2757 |
| UGCAGCAGUGUGGAGGUCCA | 2758 |
| UUGCAGCAGUGUGGAGGUCC | 2759 |
| GGUGGAGGAAAUUCCCAGCA | 2760 |
| ACGAAGGGUGGAGGAAAUUC | 2761 |
| GACGAAGGGUGGAGGAAAUU | 2762 |
| AUGACGAAGGGUGGAGGAAA | 2763 |
| CAUGACGAAGGGUGGAGGAA | 2764 |
| GCAUGACGAAGGGUGGAGGA | 2765 |
| UGCAUGACGAAGGGUGGAGG | 2766 |
| CUGCAUGACGAAGGGUGGAG | 2767 |
| ACUGCAUGACGAAGGGUGGA | 2768 |
| CACUGCAUGACGAAGGGUGG | 2769 |
| CCACUGCAUGACGAAGGGUG | 2770 |
| UCCACUGCAUGACGAAGGGU | 2771 |
| CUCCACUGCAUGACGAAGGG | 2772 |
| CCUCCACUGCAUGACGAAGG | 2773 |

TABLE 4-continued

| Sequence | SEQ ID NO: |
|---|---|
| CCCUCCACUGCAUGACGAAG | 2774 |
| CUUAGUAGGAAUGGAGGCGG | 2775 |
| CCUUAGUAGGAAUGGAGGCG | 2776 |
| CCCUUAGUAGGAAUGGAGGC | 2777 |
| UCGGUUGGAAUGAUUCUGGG | 2778 |
| GUCGGUUGGAAUGAUUCUGG | 2779 |
| GGUCGGUUGGAAUGAUUCUG | 2780 |
| GGGUCGGUUGGAAUGAUUCU | 2781 |
| UGGGUCGGUUGGAAUGAUUC | 2782 |
| GUGGGUCGGUUGGAAUGAUU | 2783 |
| AGUGGGUCGGUUGGAAUGAU | 2784 |
| CAGUGGGUCGGUUGGAAUGA | 2785 |
| GCAGUGGGUCGGUUGGAAUG | 2786 |
| UGCAGUGGGUCGGUUGGAAU | 2787 |
| UUGCAGUGGGUCGGUUGGAA | 2788 |
| UUUGCAGUGGGUCGGUUGGA | 2789 |
| CUUUGCAGUGGGUCGGUUGG | 2790 |
| UCUUUGCAGUGGGUCGGUUG | 2791 |
| UAGUCUUUGCAGUGGGUCGG | 2792 |
| AUAGUCUUUGCAGUGGGUCG | 2793 |
| CUGUCAUAGUCUUUGCAGUG | 2794 |
| UGCUGUCAUAGUCUUUGCAG | 2795 |
| UCUAGCCUGUACUGUCUGCA | 2796 |
| AUCUAGCCUGUACUGUCUGC | 2797 |
| UAUCUAGCCUGUACUGUCUG | 2798 |
| UUAUCUAGCCUGUACUGUCU | 2799 |
| GUUAUCUAGCCUGUACUGUC | 2800 |
| GGUUAUCUAGCCUGUACUGU | 2801 |
| GGGUUAUCUAGCCUGUACUG | 2802 |
| UGGGUUAUCUAGCCUGUACU | 2803 |
| GUGGGUUAUCUAGCCUGUAC | 2804 |
| GGUGGGUUAUCUAGCCUGUA | 2805 |
| GGGUGGGUUAUCUAGCCUGU | 2806 |
| UGGGUGGGUUAUCUAGCCUG | 2807 |
| UUGGGUGGGUUAUCUAGCCU | 2808 |
| AUUGGGUGGGUUAUCUAGCC | 2809 |
| AAUUGGGUGGGUUAUCUAGC | 2810 |
| AAAUUGGGUGGGUUAUCUAG | 2811 |

TABLE 4-continued

| Sequence | SEQ ID NO: |
|---|---|
| GGAAAUUGGGUGGGUUAUCU | 2812 |
| GGGAAAUUGGGUGGGUUAUC | 2813 |
| GAAAGGUUCUGUCACGAGGG | 2814 |
| GCUGAAAGGUUCUGUCACGA | 2815 |
| UGCUGAAAGGUUCUGUCACG | 2816 |
| GGCGUUAUGCUGAAAGGUUC | 2817 |
| AGGCGUUAUGCUGAAAGGUU | 2818 |
| GAGGCGUUAUGCUGAAAGGU | 2819 |
| UGAGGCGUUAUGCUGAAAGG | 2820 |
| GUGAGGCGUUAUGCUGAAAG | 2821 |
| AUGUGAGGCGUUAUGCUGAA | 2822 |
| GAUGUGAGGCGUUAUGCUGA | 2823 |
| GGAUGUGAGGCGUUAUGCUG | 2824 |
| GGGAUGUGAGGCGUUAUGCU | 2825 |
| CUUGGGAUGUGAGGCGUUAU | 2826 |
| AGACUUGGGAUGUGAGGCGU | 2827 |
| UAGACUUGGGAUGUGAGGCG | 2828 |
| AUAGACUUGGGAUGUGAGGC | 2829 |
| UAUAGACUUGGGAUGUGAGG | 2830 |
| GGGUAUAGACUUGGGAUGUG | 2831 |
| AGGGUAUAGACUUGGGAUGU | 2832 |
| AAGGUGGCUAGGAAAGAACA | 2833 |
| AAAGGUGGCUAGGAAAGAAC | 2834 |
| GAAAGGUGGCUAGGAAAGAA | 2835 |
| ACAUCUUGAUCUUGGCCUUU | 2836 |
| GGCUGGGAUCAAGAUGCCUG | 2837 |
| GUCAGGCUGGGAUCAAGAUG | 2838 |
| AGUCAGGCUGGGAUCAAGAU | 2839 |
| CAGUCAGGCUGGGAUCAAGA | 2840 |
| AGCAGUCAGGCUGGGAUCAA | 2841 |
| GAUGUAGCAGCAGUCAGGCU | 2842 |
| GGAUUAGAUGUAGCAGCAGU | 2843 |
| GGGAUUAGAUGUAGCAGCAG | 2844 |
| GACAGGAGGCAUUGGUAGGG | 2845 |
| UUAGGGACAGGAGGCAUUGG | 2846 |
| UUUAGGGACAGGAGGCAUUG | 2847 |
| GAGUUUAGGGACAGGAGGCA | 2848 |
| GGAGUUUAGGGACAGGAGGC | 2849 |

TABLE 4-continued

| Sequence | SEQ ID NO: |
|---|---|
| GCUGUCAUCAGUAUGCUGGG | 2850 |
| GGCUGUCAUCAGUAUGCUGG | 2851 |
| GGGCUGUCAUCAGUAUGCUG | 2852 |
| AGGGCUGUCAUCAGUAUGCU | 2853 |
| AGAGAGGGCUGUCAUCAGUA | 2854 |
| CAGAGAGGGCUGUCAUCAGU | 2855 |
| UCAGAGAGGGCUGUCAUCAG | 2856 |
| GUCAGAGAGGGCUGUCAUCA | 2857 |
| GGUAAAGUCAGAGAGGGCUG | 2858 |
| GGGAAGGGUAUGAAGACAGA | 2859 |
| GUCAGAAGUCUUAGUGGUAA | 2860 |
| AGUCAGAAGUCUUAGUGGUA | 2861 |
| GAGUCAGAAGUCUUAGUGGU | 2862 |
| CUGGGACUGGGUGUUGAUGG | 2863 |
| AUCUGGGACUGGGUGUUGAU | 2864 |
| GAUCUGGGACUGGGUGUUGA | 2865 |
| UGGAUCUGGGACUGGGUGUU | 2866 |
| UUUGGAUCUGGGACUGGGUG | 2867 |
| GCUUUGGAUCUGGGACUGGG | 2868 |

In some embodiments, the antisense nucleic acid molecules targeted to Transcript D comprise or consist of the nucleotide sequences shown in Table 5.

TABLE 5

| Sequence | SEQ ID NO: |
|---|---|
| ACACUGCUGAGCUGGAAGAC | 2869 |
| CGAGACACUGCUGAGCUGGA | 2870 |
| ACGAGACACUGCUGAGCUGG | 2871 |
| AACGAGACACUGCUGAGCUG | 2872 |
| GAACGAGACACUGCUGAGCU | 2873 |
| GGAACGAGACACUGCUGAGC | 2874 |
| GGGAACGAGACACUGCUGAG | 2875 |
| AGGGAACGAGACACUGCUGA | 2876 |
| CAGGGAACGAGACACUGCUG | 2877 |
| CCAGGGAACGAGACACUGCU | 2878 |
| AAGGAUGUCGGUCUGCUACC | 2879 |
| GAAGGAUGUCGGUCUGCUAC | 2880 |
| AGAAGGAUGUCGGUCUGCUA | 2881 |

TABLE 5-continued

| Sequence | SEQ ID NO: |
|---|---|
| UAGGCCCAGAAGGAUGUCGG | 2882 |
| GUAGGCCCAGAAGGAUGUCG | 2883 |
| UGUAGGCCCAGAAGGAUGUC | 2884 |
| CUGUAGGCCCAGAAGGAUGU | 2885 |
| CCUGUAGGCCCAGAAGGAUG | 2886 |
| ACCUGUAGGCCCAGAAGGAU | 2887 |
| CUUCUCAUCGGGCAUCACAG | 2888 |
| CCUUCUCAUCGGGCAUCACA | 2889 |
| ACCUUCUCAUCGGGCAUCAC | 2890 |
| CACCUUCUCAUCGGGCAUCA | 2891 |
| GCACCUUCUCAUCGGGCAUC | 2892 |
| GGCACCUUCUCAUCGGGCAU | 2893 |
| UGGCACCUUCUCAUCGGGCA | 2894 |
| AUGGCACCUUCUCAUCGGGC | 2895 |
| CAUGGCACCUUCUCAUCGGG | 2896 |
| GCAUGGCACCUUCUCAUCGG | 2897 |
| GGCAUGGCACCUUCUCAUCG | 2898 |
| GAGGCAUGGCACCUUCUCAU | 2899 |
| GGAGGCAUGGCACCUUCUCA | 2900 |
| GACUCCCAGGCAGAAAAGAG | 2901 |
| GGACUCCCAGGCAGAAAAGA | 2902 |
| AGGACUCCCAGGCAGAAAAG | 2903 |
| UCAGGACUCCCAGGCAGAAA | 2904 |
| GAAGUCAGGACUCCCAGGCA | 2905 |
| GUGGAAGUCAGGACUCCCAG | 2906 |
| UCGUGGAAGUCAGGACUCCC | 2907 |
| CUCGUGGAAGUCAGGACUCC | 2908 |
| CCUCGUGGAAGUCAGGACUC | 2909 |
| UGGGUCCUCGUGGAAGUCAG | 2910 |
| CUGGGUCCUCGUGGAAGUCA | 2911 |
| UCUGGGUCCUCGUGGAAGUC | 2912 |
| GUCUGGGUCCUCGUGGAAGU | 2913 |
| AAGAAGGAGUUGUGUUUGAG | 2914 |
| CCAAGAAGGAGUUGUGUUUG | 2915 |
| GUUCCAAGAAGGAGUUGUGU | 2916 |
| GGUUCCAAGAAGGAGUUGUG | 2917 |
| CAGGUCAACUGACUGGGAGC | 2918 |
| UGCCUGUUUACCACUGAGCU | 2919 |

TABLE 5-continued

| Sequence | SEQ ID NO: |
|---|---|
| AUGCCUGUUUACCACUGAGC | 2920 |
| UAUGCCUGUUUACCACUGAG | 2921 |
| UUAUGCCUGUUUACCACUGA | 2922 |
| UUUAUGCCUGUUUACCACUG | 2923 |
| CUUUAUGCCUGUUUACCACU | 2924 |
| ACUUUAUGCCUGUUUACCAC | 2925 |
| UAGAGAUAGUGACAGCCUGG | 2926 |
| GUAGAGAUAGUGACAGCCUG | 2927 |
| UGGUGGUAGAGAUAGUGACA | 2928 |
| GUGGUGGUAGAGAUAGUGAC | 2929 |
| UAGAGGAGUGGUGGUAGAGA | 2930 |
| ACUAGAGGAGUGGUGGUAGA | 2931 |
| AGACUAGAGGAGUGGUGGUA | 2932 |
| CAGACUAGAGGAGUGGUGGU | 2933 |
| CCAGACUAGAGGAGUGGUGG | 2934 |
| GCCAGACUAGAGGAGUGGUG | 2935 |
| GGCCAGACUAGAGGAGUGGU | 2936 |
| GCCCAGAUGUGCUAGAAUGG | 2937 |
| UGCCCAGAUGUGCUAGAAUG | 2938 |
| UUGCCCAGAUGUGCUAGAAU | 2939 |
| UUUGCCCAGAUGUGCUAGAA | 2940 |
| UUUUGCCCAGAUGUGCUAGA | 2941 |
| CCAGUUUUGCCCAGAUGUGC | 2942 |
| AUCCAGUUUUGCCCAGAUGU | 2943 |
| CCAUCCAGUUUUGCCCAGAU | 2944 |
| CACCAUCCAGUUUUGCCCAG | 2945 |
| CCACCAUCCAGUUUUGCCCA | 2946 |
| CCCACCAUCCAGUUUUGCCC | 2947 |
| UUGCUCCCAGCUUGGUAAGU | 2948 |
| GCUUGCUCCCAGCUUGGUAA | 2949 |
| AUCCUGCUUGCUCCCAGCUU | 2950 |
| AAUCCUGCUUGCUCCCAGCU | 2951 |
| CAAUCCUGCUUGCUCCCAGC | 2952 |
| CCAAUCCUGCUUGCUCCCAG | 2953 |
| AACCUUUCAGCUUCUCCAGG | 2954 |
| UAACCUUUCAGCUUCUCCAG | 2955 |
| UUAACCUUUCAGCUUCUCCA | 2956 |
| ACUGCUGCUUAACCUUUCAG | 2957 |

TABLE 5-continued

| Sequence | SEQ ID NO: |
|---|---|
| UACUGCUGCUUAACCUUUCA | 2958 |
| CUACUGCUGCUUAACCUUUC | 2959 |
| CCUACUGCUGCUUAACCUUU | 2960 |
| GCCUACUGCUGCUUAACCUU | 2961 |
| CAGGACAGGAGUAGGCACCU | 2962 |
| ACAGGACAGGAGUAGGCACC | 2963 |
| GCACAGGACAGGAGUAGGCA | 2964 |
| AUAGGCACAGGACAGGAGUA | 2965 |
| GAUAGGCACAGGACAGGAGU | 2966 |
| UGAUAGGCACAGGACAGGAG | 2967 |
| ACCCUCUGCAAAUGUGAUAG | 2968 |
| CUUACCCUCUGCAAAUGUGA | 2969 |
| GUCUUACCCUCUGCAAAUGU | 2970 |
| UGUCUUACCCUCUGCAAAUG | 2971 |
| UUGUCUUACCCUCUGCAAAU | 2972 |
| CUUGUCUUACCCUCUGCAAA | 2973 |
| UCUUGUCUUACCCUCUGCAA | 2974 |
| CAUUCUUGUCUUACCCUCUG | 2975 |
| CCCAUUCUUGUCUUACCCUC | 2976 |
| GAGCCUCAUCUUGUCCCUCC | 2977 |
| UGAGCCUCAUCUUGUCCCUC | 2978 |

In some embodiments, the antisense nucleic acid molecules targeted to Transcript E comprise or consist of the nucleotide sequences shown in Table 6.

TABLE 6

| Sequence | SEQ ID NO: |
|---|---|
| ACCACGCAGUCAACCUUCUG | 2979 |
| UACCACGCAGUCAACCUUCU | 2980 |
| CUACCACGCAGUCAACCUUC | 2981 |
| CCUACCACGCAGUCAACCUU | 2982 |
| CCCUACCACGCAGUCAACCU | 2983 |
| UUGCCUUCGGCUUGCUCUGG | 2984 |
| CUUGCCUUCGGCUUGCUCUG | 2985 |
| GCUUGCCUUCGGCUUGCUCU | 2986 |
| UGCUUGCCUUCGGCUUGCUC | 2987 |
| GUGCUUGCCUUCGGCUUGCU | 2988 |
| UCGUGCUUGCCUUCGGCUUG | 2989 |
| AUCGUGCUUGCCUUCGGCUU | 2990 |

TABLE 6-continued

| Sequence | SEQ ID NO: |
|---|---|
| CAUCGUGCUUGCCUUCGGCU | 2991 |
| AGCGCCAUCGUGCUUGCCUU | 2992 |
| UGGUGAGCGCCAUCGUGCUU | 2993 |
| CUGAUGCUCGGCUGCUACAG | 2994 |
| GCUGAUGCUCGGCUGCUACA | 2995 |
| UUUCGGGCUGAUGCUCGGCU | 2996 |
| UCCUUUCGGGCUGAUGCUCG | 2997 |
| UUCCUUUCGGGCUGAUGCUC | 2998 |
| CUUCCUUUCGGGCUGAUGCU | 2999 |
| GCUUCCUUUCGGGCUGAUGC | 3000 |
| UGCUUCCUUUCGGGCUGAUG | 3001 |
| GUGCUUCCUUUCGGGCUGAU | 3002 |
| CGUGCUUCCUUUCGGGCUGA | 3003 |
| UCGUGCUUCCUUUCGGGCUG | 3004 |
| UUCGUGCUUCCUUUCGGGCU | 3005 |
| UUUCGUGCUUCCUUUCGGGC | 3006 |
| CUUUCGUGCUUCCUUUCGGG | 3007 |
| GCUUUCGUGCUUCCUUUCGG | 3008 |
| AUGUACGCCAGCGUGCUGCU | 3009 |
| UCAGCAUGUACGCCAGCGUG | 3010 |
| AGGCGGUGUACUACGUGUGC | 3011 |
| AAGGCGGUGUACUACGUGUG | 3012 |
| CAAGGCGGUGUACUACGUGU | 3013 |
| GCAAGGCGGUGUACUACGUG | 3014 |
| UGCAAGGCGGUGUACUACGU | 3015 |
| CUGCAAGGCGGUGUACUACG | 3016 |
| GCUGCAAGGCGGUGUACUAC | 3017 |
| GGCUGCAAGGCGGUGUACUA | 3018 |
| GCUCUUUGUGGCCUUCCUGA | 3019 |
| CGCUCUUUGUGGCCUUCCUG | 3020 |

In some embodiments, the antisense nucleic acid molecules targeted to Transcript F comprise or consist of the nucleotide sequences shown in Table 7.

TABLE 7

| Sequence | SEQ ID NO: |
|---|---|
| AGAAGUCCUCACUGUCCACU | 3021 |
| AAGAAGUCCUCACUGUCCAC | 3022 |
| GAAGAAGUCCUCACUGUCCA | 3023 |
| GGAAGAAGUCCUCACUGUCC | 3024 |

TABLE 7-continued

| Sequence | SEQ ID NO: |
|---|---|
| UGGAAGAAGUCCUCACUGUC | 3025 |
| CUGGAAGAAGUCCUCACUGU | 3026 |
| AGCUGGAAGAAGUCCUCACU | 3027 |
| ACUGCAACACCAUCAGGCAC | 3028 |
| GACUGCAACACCAUCAGGCA | 3029 |
| AGACUGCAACACCAUCAGGC | 3030 |
| CAGACUGCAACACCAUCAGG | 3031 |
| CCAGACUGCAACACCAUCAG | 3032 |
| GACCAGACUGCAACACCAUC | 3033 |
| CUCUGACCAGACUGCAACAC | 3034 |
| AGCUCUGACCAGACUGCAAC | 3035 |
| CCAGCUCUGACCAGACUGCA | 3036 |
| UGUAGGGCUCCAGCUCUGAC | 3037 |
| CUUGUAGGGCUCCAGCUCUG | 3038 |
| CCUUGUAGGGCUCCAGCUCU | 3039 |
| ACAGGCAUUGGAAGCAGCCC | 3040 |
| GACAGGCAUUGGAAGCAGCC | 3041 |
| AAGGACAGGCAUUGGAAGCA | 3042 |
| AAAGGACAGGCAUUGGAAGC | 3043 |
| UAAAGGACAGGCAUUGGAAG | 3044 |
| CUAAAGGACAGGCAUUGGAA | 3045 |
| GCUCUAAAGGACAGGCAUUG | 3046 |
| AGCUCUAAAGGACAGGCAUU | 3047 |
| AAGCUCUAAAGGACAGGCAU | 3048 |
| AAAGCUCUAAAGGACAGGCA | 3049 |
| GAAAGCUCUAAAGGACAGGC | 3050 |
| CGGGAAAGCUCUAAAGGACA | 3051 |
| CCGGGAAAGCUCUAAAGGAC | 3052 |
| AGGGUUAAGCUAGAGAGGAA | 3053 |
| UCAGGGUUAAGCUAGAGAGG | 3054 |
| GAUCAGGGUUAAGCUAGAGA | 3055 |
| GGAUCAGGGUUAAGCUAGAG | 3056 |
| AGGAUCAGGGUUAAGCUAGA | 3057 |
| CCCAGGAUCAGGGUUAAGCU | 3058 |
| CAACUCCUCCUGCACCUGGU | 3059 |
| ACAACUCCUCCUGCACCUGG | 3060 |
| GACAAUUCCACAACUCCUCC | 3061 |
| UGACAAUUCCACAACUCCUC | 3062 |
| UUGACAAUUCCACAACUCCU | 3063 |

TABLE 7-continued

| Sequence | SEQ ID NO: |
|---|---|
| CUUGACAAUUCCACAACUCC | 3064 |
| UCCUUGACAAUUCCACAACU | 3065 |
| AUCCUUGACAAUUCCACAAC | 3066 |
| CAUCCUUGACAAUUCCACAA | 3067 |
| ACAUCCUUGACAAUUCCACA | 3068 |
| GACAUCCUUGACAAUUCCAC | 3069 |
| UGACAUCCUUGACAAUUCCA | 3070 |
| UGUGUGACAUCCUUGACAAU | 3071 |
| ACUGUGUGACAUCCUUGACA | 3072 |
| ACUUUCUGUCCACUGUGUGA | 3073 |
| CCUCGCUUGGACUUUCUGUC | 3074 |
| CCCUCGCUUGGACUUUCUGU | 3075 |
| UCCCUCGCUUGGACUUUCUG | 3076 |
| CUCCCUCGCUUGGACUUUCU | 3077 |
| CCUCCCUCGCUUGGACUUUC | 3078 |
| CCCUCCCUCGCUUGGACUUU | 3079 |
| UCCAUCAGCACUGGGUCAGA | 3080 |
| ACCACUAAUCUCCAUCAGCA | 3081 |
| CACCACUAAUCUCCAUCAGC | 3082 |
| CCACCACUAAUCUCCAUCAG | 3083 |
| CCCACCACUAAUCUCCAUCA | 3084 |
| ACCAGACACCCACCACUAAU | 3085 |
| UACCAGACACCCACCACUAA | 3086 |
| CUCAUACCAGACACCCACCA | 3087 |
| CCUCAUACCAGACACCCACC | 3088 |
| UCCUCAUACCAGACACCCAC | 3089 |
| AUCCUCAUACCAGACACCCA | 3090 |
| GAUCCUCAUACCAGACACCC | 3091 |
| AGAUCCUCAUACCAGACACC | 3092 |
| UAGAUCCUCAUACCAGACAC | 3093 |
| GUAGAUCCUCAUACCAGACA | 3094 |
| AGUAGAUCCUCAUACCAGAC | 3095 |
| CAGUAGAUCCUCAUACCAGA | 3096 |
| UGCAGUAGAUCCUCAUACCA | 3097 |
| GUGCAGUAGAUCCUCAUACC | 3098 |
| AGUGCAGUAGAUCCUCAUAC | 3099 |
| ACUCUGUAGGACACCCUUGU | 3100 |
| CACUCUGUAGGACACCCUUG | 3101 |
| CCACUCUGUAGGACACCCUU | 3102 |

TABLE 7-continued

| Sequence | SEQ ID NO: |
|---|---|
| UCCACUCUGUAGGACACCCU | 3103 |
| CUCCACUCUGUAGGACACCC | 3104 |
| ACUCCACUCUGUAGGACACC | 3105 |
| CACUCCACUCUGUAGGACAC | 3106 |
| AGCACUCCACUCUGUAGGAC | 3107 |
| UAUGACAGCACUCCACUCUG | 3108 |
| AUAUGACAGCACUCCACUCU | 3109 |
| UUGCUGUGCUUGGGCCUCUC | 3110 |
| ACGUCAAAGGUGAAUCGGGC | 3111 |
| CACGUCAAAGGUGAAUCGGG | 3112 |
| ACACGUCAAAGGUGAAUCGG | 3113 |
| UACACGUCAAAGGUGAAUCG | 3114 |
| GUACACGUCAAAGGUGAAUC | 3115 |
| GGCUGCCAAAGAGGUCUCGA | 3116 |
| UCAGGCUGCCAAAGAGGUCU | 3117 |
| CAUUCAGGCUGCCAAAGAGG | 3118 |
| GACAUUCAGGCUGCCAAAGA | 3119 |
| UGACAUUCAGGCUGCCAAAG | 3120 |
| CUUUGACAUUCAGGCUGCCA | 3121 |
| GCUUUGACAUUCAGGCUGCC | 3122 |
| CCGUAGAAUGUGGCUUUGAC | 3123 |
| GCCCGUAGAAUGUGGCUUUG | 3124 |
| UAGAGCCCGUAGAAUGUGGC | 3125 |
| GUAGAGCCCGUAGAAUGUGG | 3126 |
| AGUAGAGCCCGUAGAAUGUG | 3127 |
| AGAGUAGAGCCCGUAGAAUG | 3128 |
| UAGAGUAGAGCCCGUAGAAU | 3129 |
| AUAGAGUAGAGCCCGUAGAA | 3130 |
| CAUAGAGUAGAGCCCGUAGA | 3131 |
| UCAUAGAGUAGAGCCCGUAG | 3132 |
| CUCAUAGAGUAGAGCCCGUA | 3133 |
| GAAAGUCACAACUCAUAGAG | 3134 |
| CCUUGAAAGUCACAACUCAU | 3135 |
| AAGUCCUUGAAAGUCACAAC | 3136 |
| CCAAGUCCUUGAAAGUCACA | 3137 |
| UUCUUUGGGCCAAGUCCUUG | 3138 |
| UUUCUUUGGGCCAAGUCCUU | 3139 |
| UUGAUUUCUGACCUGAGUAC | 3140 |
| GUUGAUUUCUGACCUGAGUA | 3141 |

TABLE 7-continued

| Sequence | SEQ ID NO: |
|---|---|
| GGGACUAUCCAACUGUAGGG | 3142 |
| GCAAGAGGACGAAUUAUGGG | 3143 |
| UGCAAGAGGACGAAUUAUGG | 3144 |
| GUGCAAGAGGACGAAUUAUG | 3145 |
| GGUGCAAGAGGACGAAUUAU | 3146 |
| GGGUGCAAGAGGACGAAUUA | 3147 |
| UGGGUGCAAGAGGACGAAUU | 3148 |
| GUGGGUGCAAGAGGACGAAU | 3149 |
| GGUGGGUGCAAGAGGACGAA | 3150 |
| UAGGUGGGUGCAAGAGGACG | 3151 |
| GUAGGUGGGUGCAAGAGGAC | 3152 |
| GGUAGGUGGGUGCAAGAGGA | 3153 |
| CCACAAGCAAGAGCUAACUA | 3154 |
| ACUUUCCACAAGCAAGAGCU | 3155 |
| GACUUUCCACAAGCAAGAGC | 3156 |
| GGACUUUCCACAAGCAAGAG | 3157 |
| AGGACUUUCCACAAGCAAGA | 3158 |
| GAGGACUUUCCACAAGCAAG | 3159 |
| UGAGGACUUUCCACAAGCAA | 3160 |
| AUGAGGACUUUCCACAAGCA | 3161 |
| GAUGAGGACUUUCCACAAGC | 3162 |
| AGAUGAGGACUUUCCACAAG | 3163 |
| GAGAUGAGGACUUUCCACAA | 3164 |
| GGAGAUGAGGACUUUCCACA | 3165 |
| UGGGAGAUGAGGACUUUCCA | 3166 |
| GCUGGGAGAUGAGGACUUUC | 3167 |
| UCAAGCUGGGAGAUGAGGAC | 3168 |
| AAGCCAUCAAGCUGGGAGAU | 3169 |
| GAAGCCAUCAAGCUGGGAGA | 3170 |
| GGAGGAAGCCAUCAAGCUGG | 3171 |
| GGGAGGAAGCCAUCAAGCUG | 3172 |
| AACUUGGGAGGAAGCCAUCA | 3173 |
| AAACUUGGGAGGAAGCCAUC | 3174 |
| CAGCAGUGUGGAGGUCCAAC | 3175 |
| GCAGCAGUGUGGAGGUCCAA | 3176 |
| UGCAGCAGUGUGGAGGUCCA | 3177 |
| UUGCAGCAGUGUGGAGGUCC | 3178 |
| GGUGGAGGAAAUUCCCAGCA | 3179 |
| ACGAAGGGUGGAGGAAAUUC | 3180 |

TABLE 7-continued

| Sequence | SEQ ID NO: |
|---|---|
| GACGAAGGGUGGAGGAAAUU | 3181 |
| AUGACGAAGGGUGGAGGAAA | 3182 |
| CAUGACGAAGGGUGGAGGAA | 3183 |
| GCAUGACGAAGGGUGGAGGA | 3184 |
| UGCAUGACGAAGGGUGGAGG | 3185 |
| CUGCAUGACGAAGGGUGGAG | 3186 |
| ACUGCAUGACGAAGGGUGGA | 3187 |
| CACUGCAUGACGAAGGGUGG | 3188 |
| CCACUGCAUGACGAAGGGUG | 3189 |
| UCCACUGCAUGACGAAGGGU | 3190 |
| CUCCACUGCAUGACGAAGGG | 3191 |
| CCUCCACUGCAUGACGAAGG | 3192 |
| CCCUCCACUGCAUGACGAAG | 3193 |
| CUUAGUAGGAAUGGAGGCGG | 3194 |
| CCUUAGUAGGAAUGGAGGCG | 3195 |
| CCCUUAGUAGGAAUGGAGGC | 3196 |

In some embodiments, the siRNA molecules targeted to Transcript A comprise or consist of the nucleotide sequences (sense and antisense strands) shown in Table 8.

TABLE 8

| Sense Sequence | SEQ ID NO: | Antisense Sequence | SEQ ID NO: |
|---|---|---|---|
| GACCGCCUGCAGAAGGUUG | 3197 | CAACCUUCUGCAGGCGGUC | 3198 |
| ACCGCCUGCAGAAGGUUGA | 3199 | UCAACCUUCUGCAGGCGGU | 3200 |
| CCGCCUGCAGAAGGUUGAC | 3201 | GUCAACCUUCUGCAGGCGG | 3202 |
| CGCCUGCAGAAGGUUGACU | 3203 | AGUCAACCUUCUGCAGGCG | 3204 |
| GCCUGCAGAAGGUUGACUG | 3205 | CAGUCAACCUUCUGCAGGC | 3206 |
| CAGAAGGUUGACUGCGUGG | 3207 | CCACGCAGUCAACCUUCUG | 3208 |
| AGAAGGUUGACUGCGUGGU | 3209 | ACCACGCAGUCAACCUUCU | 3210 |
| GAAGGUUGACUGCGUGGUA | 3211 | UACCACGCAGUCAACCUUC | 3212 |
| AAGGUUGACUGCGUGGUAG | 3213 | CUACCACGCAGUCAACCUU | 3214 |
| AGGUUGACUGCGUGGUAGG | 3215 | CCUACCACGCAGUCAACCU | 3216 |
| GGUUGACUGCGUGGUAGGG | 3217 | CCCUACCACGCAGUCAACC | 3218 |
| CCAGAGCAAGCCGAAGGCA | 3219 | UGCCUUCGGCUUGCUCUGG | 3220 |
| CAGAGCAAGCCGAAGGCAA | 3221 | UUGCCUUCGGCUUGCUCUG | 3222 |
| AGAGCAAGCCGAAGGCAAG | 3223 | CUUGCCUUCGGCUUGCUCU | 3224 |
| GAGCAAGCCGAAGGCAAGC | 3225 | GCUUGCCUUCGGCUUGCUC | 3226 |
| AGCAAGCCGAAGGCAAGCA | 3227 | UGCUUGCCUUCGGCUUGCU | 3228 |
| GCAAGCCGAAGGCAAGCAC | 3229 | GUGCUUGCCUUCGGCUUGC | 3230 |
| CAAGCCGAAGGCAAGCACG | 3231 | CGUGCUUGCCUUCGGCUUG | 3232 |
| AAGCCGAAGGCAAGCACGA | 3233 | UCGUGCUUGCCUUCGGCUU | 3234 |
| AGCCGAAGGCAAGCACGAU | 3235 | AUCGUGCUUGCCUUCGGCU | 3236 |
| GCCGAAGGCAAGCACGAUG | 3237 | CAUCGUGCUUGCCUUCGGC | 3238 |
| AAGGCAAGCACGAUGGCGC | 3239 | GCGCCAUCGUGCUUGCCUU | 3240 |
| AGGCAAGCACGAUGGCGCU | 3241 | AGCGCCAUCGUGCUUGCCU | 3242 |
| AAGCACGAUGGCGCUCACC | 3243 | GGUGAGCGCCAUCGUGCUU | 3244 |
| AGCACGAUGGCGCUCACCA | 3245 | UGGUGAGCGCCAUCGUGCU | 3246 |
| CUGUAGCAGCCGAGCAUCA | 3247 | UGAUGCUCGGCUGCUACAG | 3248 |
| AGCCGAGCAUCAGCCCGAA | 3249 | UUCGGGCUGAUGCUCGGCU | 3250 |
| GUCAGAGUCUCCAGGCUCA | 3251 | UGAGCCUGGAGACUCUGAC | 3252 |
| UCAGAGUCUCCAGGCUCAG | 3253 | CUGAGCCUGGAGACUCUGA | 3254 |
| CAGAGUCUCCAGGCUCAGG | 3255 | CCUGAGCCUGGAGACUCUG | 3256 |
| AGAGUCUCCAGGCUCAGGU | 3257 | ACCUGAGCCUGGAGACUCU | 3258 |
| GAGUCUCCAGGCUCAGGUG | 3259 | CACCUGAGCCUGGAGACUC | 3260 |
| AGUCUCCAGGCUCAGGUGG | 3261 | CCACCUGAGCCUGGAGACU | 3262 |
| GGGUGGCACAGCUGGCAUA | 3263 | UAUGCCAGCUGUGCCACCC | 3264 |
| GUGGCACAGCUGGCAUACG | 3265 | CGUAUGCCAGCUGUGCCAC | 3266 |
| UGGCACAGCUGGCAUACGC | 3267 | GCGUAUGCCAGCUGUGCCA | 3268 |
| CUCCACAGGUGGCGGUAGA | 3269 | UCUACCGCCACCUGUGGAG | 3270 |
| UCCACAGGUGGCGGUAGAC | 3271 | GUCUACCGCCACCUGUGGA | 3272 |
| UGAGCAGCACGCUGGCGUA | 3273 | UACGCCAGCGUGCUGCUCA | 3274 |
| AGCAGCACGCUGGCGUACA | 3275 | UGUACGCCAGCGUGCUGCU | 3276 |
| GCAGCACGCUGGCGUACAU | 3277 | AUGUACGCCAGCGUGCUGC | 3278 |
| CAGCACGCUGGCGUACAUG | 3279 | CAUGUACGCCAGCGUGCUG | 3280 |
| AGCACGCUGGCGUACAUGC | 3281 | GCAUGUACGCCAGCGUGCU | 3282 |
| GCACGCUGGCGUACAUGCU | 3283 | AGCAUGUACGCCAGCGUGC | 3284 |
| CACGCUGGCGUACAUGCUG | 3285 | CAGCAUGUACGCCAGCGUG | 3286 |
| ACGCUGGCGUACAUGCUGA | 3287 | UCAGCAUGUACGCCAGCGU | 3288 |
| CUGGCGUACAUGCUGAGCG | 3289 | CGCUCAGCAUGUACGCCAG | 3290 |
| UGGCGUACAUGCUGAGCGC | 3291 | GCGCUCAGCAUGUACGCCA | 3292 |
| CGCGCACACGUAGUACACC | 3293 | GGUGUACUACGUGUGCGCG | 3294 |
| GCGCACACGUAGUACACCG | 3295 | CGGUGUACUACGUGUGCGC | 3296 |
| CGCACACGUAGUACACCGC | 3297 | GCGGUGUACUACGUGUGCG | 3298 |
| GCACACGUAGUACACCGCC | 3299 | GGCGGUGUACUACGUGUGC | 3300 |
| CACACGUAGUACACCGCCU | 3301 | AGGCGGUGUACUACGUGUG | 3302 |
| ACACGUAGUACACCGCCUU | 3303 | AAGGCGGUGUACUACGUGU | 3304 |
| CACGUAGUACACCGCCUUG | 3305 | CAAGGCGGUGUACUACGUG | 3306 |

TABLE 8-continued

| Sense Sequence | SEQ ID NO: | Antisense Sequence | SEQ ID NO: |
|---|---|---|---|
| UAGUACACCGCCUUGCAGC | 3307 | GCUGCAAGGCGGUGUACUA | 3308 |
| CCAAGCUCCACACCACGAA | 3309 | UUCGUGGUGUGGAGCUUGG | 3310 |
| CAAGCUCCACACCACGAAG | 3311 | CUUCGUGGUGUGGAGCUUG | 3312 |
| AAGCUCCACACCACGAAGC | 3313 | GCUUCGUGGUGUGGAGCUU | 3314 |
| AGCUCCACACCACGAAGCC | 3315 | GGCUUCGUGGUGUGGAGCU | 3316 |
| CUCCACACCACGAAGCCGU | 3317 | ACGGCUUCGUGGUGUGGAG | 3318 |
| UCCACACCACGAAGCCGUU | 3319 | AACGGCUUCGUGGUGUGGA | 3320 |
| CCACACCACGAAGCCGUUG | 3321 | CAACGGCUUCGUGGUGUGG | 3322 |
| CACACCACGAAGCCGUUGC | 3323 | GCAACGGCUUCGUGGUGUG | 3324 |
| ACACCACGAAGCCGUUGCC | 3325 | GGCAACGGCUUCGUGGUGU | 3326 |
| CACCACGAAGCCGUUGCCA | 3327 | UGGCAACGGCUUCGUGGUG | 3328 |
| ACCACGAAGCCGUUGCCAG | 3329 | CUGGCAACGGCUUCGUGGU | 3330 |
| CCGCGAAGUCUUCCAGCUC | 3331 | GAGCUGGAAGACUUCGCGG | 3332 |
| CGCGAAGUCUUCCAGCUCA | 3333 | UGAGCUGGAAGACUUCGCG | 3334 |
| GCGAAGUCUUCCAGCUCAG | 3335 | CUGAGCUGGAAGACUUCGC | 3336 |
| UUCCAGCUCAGCAGUGUCU | 3337 | AGACACUGCUGAGCUGGAA | 3338 |
| UCCAGCUCAGCAGUGUCUC | 3339 | GAGACACUGCUGAGCUGGA | 3340 |
| CCAGCUCAGCAGUGUCUCG | 3341 | CGAGACACUGCUGAGCUGG | 3342 |
| CAGCUCAGCAGUGUCUCGU | 3343 | ACGAGACACUGCUGAGCUG | 3344 |
| AGCUCAGCAGUGUCUCGUU | 3345 | AACGAGACACUGCUGAGCU | 3346 |
| GCUCAGCAGUGUCUCGUUC | 3347 | GAACGAGACACUGCUGAGC | 3348 |
| CUCAGCAGUGUCUCGUUCC | 3349 | GGAACGAGACACUGCUGAG | 3350 |
| GUAGCAGACCGACAUCCUU | 3351 | AAGGAUGUCGGUCUGCUAC | 3352 |
| UAGCAGACCGACAUCCUUC | 3353 | GAAGGAUGUCGGUCUGCUA | 3354 |
| AGCAGACCGACAUCCUUCU | 3355 | AGAAGGAUGUCGGUCUGCU | 3356 |
| AGACCGACAUCCUUCUGGG | 3357 | CCCAGAAGGAUGUCGGUCU | 3358 |
| GACCGACAUCCUUCUGGGC | 3359 | GCCCAGAAGGAUGUCGGUC | 3360 |
| CCGACAUCCUUCUGGGCCU | 3361 | AGGCCCAGAAGGAUGUCGG | 3362 |
| CGACAUCCUUCUGGGCCUA | 3363 | UAGGCCCAGAAGGAUGUCG | 3364 |
| GACAUCCUUCUGGGCCUAC | 3365 | GUAGGCCCAGAAGGAUGUC | 3366 |
| CUUCUGGGCCUACAGGUGG | 3367 | CCACCUGUAGGCCCAGAAG | 3368 |
| UUCUGGGCCUACAGGUGGG | 3369 | CCCACCUGUAGGCCCAGAA | 3370 |
| UCUGGGCCUACAGGUGGGU | 3371 | ACCCACCUGUAGGCCCAGA | 3372 |
| GGCCUACAGGUGGGUGGAA | 3373 | UUCCACCCACCUGUAGGCC | 3374 |
| CCUACAGGUGGGUGGAAGG | 3375 | CCUUCCACCCACCUGUAGG | 3376 |
| CUACAGGUGGGUGGAAGGC | 3377 | GCCUUCCACCCACCUGUAG | 3378 |
| UACAGGUGGGUGGAAGGCG | 3379 | CGCCUUCCACCCACCUGUA | 3380 |
| ACUUCCCUGCAGCCUGCCU | 3381 | AGGCAGGCUGCAGGGAAGU | 3382 |

| Sense Sequence | SEQ ID NO: | Antisense Sequence | SEQ ID NO: |
|---|---|---|---|
| CCUGCAGCCUGCCUCUUUU | 3383 | AAAAGAGGCAGGCUGCAGG | 3384 |
| CUGCAGCCUGCCUCUUUUC | 3385 | GAAAAGAGGCAGGCUGCAG | 3386 |
| GCAGCCUGCCUCUUUUCUG | 3387 | CAGAAAAGAGGCAGGCUGC | 3388 |
| CAGCCUGCCUCUUUUCUGC | 3389 | GCAGAAAAGAGGCAGGCUG | 3390 |
| AGCCUGCCUCUUUUCUGCC | 3391 | GGCAGAAAAGAGGCAGGCU | 3392 |
| GCCUCUUUUCUGCCUGGGA | 3393 | UCCCAGGCAGAAAAGAGGC | 3394 |
| CUUUUCUGCCUGGGAGUCC | 3395 | GGACUCCCAGGCAGAAAAG | 3396 |
| UUUUCUGCCUGGGAGUCCU | 3397 | AGGACUCCCAGGCAGAAAA | 3398 |
| UUCUGCCUGGGAGUCCUGA | 3399 | UCAGGACUCCCAGGCAGAA | 3400 |
| UCUGCCUGGGAGUCCUGAC | 3401 | GUCAGGACUCCCAGGCAGA | 3402 |
| UGCCUGGGAGUCCUGACUU | 3403 | AAGUCAGGACUCCCAGGCA | 3404 |
| GCCUGGGAGUCCUGACUUC | 3405 | GAAGUCAGGACUCCCAGGC | 3406 |
| CUGGGAGUCCUGACUUCCA | 3407 | UGGAAGUCAGGACUCCCAG | 3408 |
| UGGGAGUCCUGACUUCCAC | 3409 | GUGGAAGUCAGGACUCCCA | 3410 |
| GGGAGUCCUGACUUCCACG | 3411 | CGUGGAAGUCAGGACUCCC | 3412 |
| GGAGUCCUGACUUCCACGA | 3413 | UCGUGGAAGUCAGGACUCC | 3414 |
| GAGUCCUGACUUCCACGAG | 3415 | CUCGUGGAAGUCAGGACUC | 3416 |
| AGUCCUGACUUCCACGAGG | 3417 | CCUCGUGGAAGUCAGGACU | 3418 |
| CCUGACUUCCACGAGGACC | 3419 | GGUCCUCGUGGAAGUCAGG | 3420 |
| CUGACUUCCACGAGGACCC | 3421 | GGGUCCUCGUGGAAGUCAG | 3422 |
| UGACUUCCACGAGGACCCA | 3423 | UGGGUCCUCGUGGAAGUCA | 3424 |
| GACUUCCACGAGGACCCAG | 3425 | CUGGGUCCUCGUGGAAGUC | 3426 |
| ACUUCCACGAGGACCCAGA | 3427 | UCUGGGUCCUCGUGGAAGU | 3428 |
| CUUCCACGAGGACCCAGAC | 3429 | GUCUGGGUCCUCGUGGAAG | 3430 |
| UUCCACGAGGACCCAGACC | 3431 | GGUCUGGGUCCUCGUGGAA | 3432 |
| CCCUGCUCCCAGUCAGUUG | 3433 | CAACUGACUGGGAGCAGGG | 3434 |
| CCUGCUCCCAGUCAGUUGA | 3435 | UCAACUGACUGGGAGCAGG | 3436 |
| CUGCUCCCAGUCAGUUGAC | 3437 | GUCAACUGACUGGGAGCAG | 3438 |
| UGCUCCCAGUCAGUUGACC | 3439 | GGUCAACUGACUGGGAGCA | 3440 |
| CCCAGUCAGUUGACCUGCC | 3441 | GGCAGGUCAACUGACUGGG | 3442 |
| CCAGUCAGUUGACCUGCCC | 3443 | GGGCAGGUCAACUGACUGG | 3444 |
| GCCUCCUUCCCAGAGCUCA | 3445 | UGAGCUCUGGGAAGGAGGC | 3446 |
| CCUCCUUCCCAGAGCUCAG | 3447 | CUGAGCUCUGGGAAGGAGG | 3448 |
| CUCCUUCCCAGAGCUCAGU | 3449 | ACUGAGCUCUGGGAAGGAG | 3450 |
| UCCUUCCCAGAGCUCAGUG | 3451 | CACUGAGCUCUGGGAAGGA | 3452 |
| CCUUCCCAGAGCUCAGUGG | 3453 | CCACUGAGCUCUGGGAAGG | 3454 |
| UUCCCAGAGCUCAGUGGUA | 3455 | UACCACUGAGCUCUGGGAA | 3456 |
| UCCCAGAGCUCAGUGGUAA | 3457 | UUACCACUGAGCUCUGGGA | 3458 |

TABLE 8-continued

| Sense Sequence | SEQ ID NO: | Antisense Sequence | SEQ ID NO: |
|---|---|---|---|
| CAGGCUGUCACUAUCUCUA | 3459 | UAGAGAUAGUGACAGCCUG | 3460 |
| AGGCUGUCACUAUCUCUAC | 3461 | GUAGAGAUAGUGACAGCCU | 3462 |
| UCUCUACCACCACUCCUCU | 3463 | AGAGGAGUGGUGGUAGAGA | 3464 |
| CCACCACUCCUCUAGUCUG | 3465 | CAGACUAGAGGAGUGGUGG | 3466 |
| CACCACUCCUCUAGUCUGG | 3467 | CCAGACUAGAGGAGUGGUG | 3468 |
| ACCACUCCUCUAGUCUGGC | 3469 | GCCAGACUAGAGGAGUGGU | 3470 |
| CCACUCCUCUAGUCUGGCC | 3471 | GGCCAGACUAGAGGAGUGG | 3472 |
| CACUCCUCUAGUCUGGCCC | 3473 | GGGCCAGACUAGAGGAGUG | 3474 |
| AUUCUAGCACAUCUGGGCA | 3475 | UGCCCAGAUGUGCUAGAAU | 3476 |
| UUCUAGCACAUCUGGGCAA | 3477 | UUGCCCAGAUGUGCUAGAA | 3478 |
| UCUAGCACAUCUGGGCAAA | 3479 | UUUGCCCAGAUGUGCUAGA | 3480 |
| CUAGCACAUCUGGGCAAAA | 3481 | UUUUGCCCAGAUGUGCUAG | 3482 |
| GGGUGUAAAGGGACGUGCA | 3483 | UGCACGUCCCUUUACACCC | 3484 |
| GGUGUAAAGGGACGUGCAC | 3485 | GUGCACGUCCCUUUACACC | 3486 |
| GUGUAAAGGGACGUGCACA | 3487 | UGUGCACGUCCCUUUACAC | 3488 |
| UGUAAAGGGACGUGCACAG | 3489 | CUGUGCACGUCCCUUUACA | 3490 |
| GUAAAGGGACGUGCACAGA | 3491 | UCUGUGCACGUCCCUUUAC | 3492 |
| UAAAGGGACGUGCACAGAU | 3493 | AUCUGUGCACGUCCCUUUA | 3494 |
| AAAGGGACGUGCACAGAUC | 3495 | GAUCUGUGCACGUCCCUUU | 3496 |
| AAGGGACGUGCACAGAUCU | 3497 | AGAUCUGUGCACGUCCCUU | 3498 |
| AGGGACGUGCACAGAUCUA | 3499 | UAGAUCUGUGCACGUCCCU | 3500 |
| CGUGCACAGAUCUACUUAC | 3501 | GUAAGUAGAUCUGUGCACG | 3502 |
| GUGCACAGAUCUACUUACC | 3503 | GGUAAGUAGAUCUGUGCAC | 3504 |
| UGCACAGAUCUACUUACCA | 3505 | UGGUAAGUAGAUCUGUGCA | 3506 |
| GCACAGAUCUACUUACCAA | 3507 | UUGGUAAGUAGAUCUGUGC | 3508 |
| CACAGAUCUACUUACCAAG | 3509 | CUUGGUAAGUAGAUCUGUG | 3510 |
| ACAGAUCUACUUACCAAGC | 3511 | GCUUGGUAAGUAGAUCUGU | 3512 |
| CAGAUCUACUUACCAAGCU | 3513 | AGCUUGGUAAGUAGAUCUG | 3514 |
| AGAUCUACUUACCAAGCUG | 3515 | CAGCUUGGUAAGUAGAUCU | 3516 |
| AUCUACUUACCAAGCUGGG | 3517 | CCCAGCUUGGUAAGUAGAU | 3518 |
| UCUACUUACCAAGCUGGGA | 3519 | UCCCAGCUUGGUAAGUAGA | 3520 |
| CUUACCAAGCUGGGAGCAA | 3521 | UUGCUCCCAGCUUGGUAAG | 3522 |
| UUACCAAGCUGGGAGCAAG | 3523 | CUUGCUCCCAGCUUGGUAA | 3524 |
| UACCAAGCUGGGAGCAAGC | 3525 | GCUUGCUCCCAGCUUGGUA | 3526 |
| ACCAAGCUGGGAGCAAGCA | 3527 | UGCUUGCUCCCAGCUUGGU | 3528 |
| GCUGGGAGCAAGCAGGAUU | 3529 | AAUCCUGCUUGCUCCCAGC | 3530 |
| CUGGGAGCAAGCAGGAUUG | 3531 | CAAUCCUGCUUGCUCCCAG | 3532 |
| UGGGAGCAAGCAGGAUUGG | 3533 | CCAAUCCUGCUUGCUCCCA | 3534 |
| GGGAGCAAGCAGGAUUGGG | 3535 | CCCAAUCCUGCUUGCUCCC | 3536 |
| AAAGGUUAAGCAGCAGUAG | 3537 | CUACUGCUGCUUAACCUUU | 3538 |
| AAGGUUAAGCAGCAGUAGG | 3539 | CCUACUGCUGCUUAACCUU | 3540 |
| AGGUUAAGCAGCAGUAGGC | 3541 | GCCUACUGCUGCUUAACCU | 3542 |
| GGUGCCUACUCCUGUCCUG | 3543 | CAGGACAGGAGUAGGCACC | 3544 |
| GUGCCUACUCCUGUCCUGU | 3545 | ACAGGACAGGAGUAGGCAC | 3546 |
| UGCCUACUCCUGUCCUGUG | 3547 | CACAGGACAGGAGUAGGCA | 3548 |
| GCCUACUCCUGUCCUGUGC | 3549 | GCACAGGACAGGAGUAGGC | 3550 |
| CCUACUCCUGUCCUGUGCC | 3551 | GGCACAGGACAGGAGUAGG | 3552 |
| CUACUCCUGUCCUGUGCCU | 3553 | AGGCACAGGACAGGAGUAG | 3554 |
| UACUCCUGUCCUGUGCCUA | 3555 | UAGGCACAGGACAGGAGUA | 3556 |
| ACUCCUGUCCUGUGCCUAU | 3557 | AUAGGCACAGGACAGGAGU | 3558 |
| CUCCUGUCCUGUGCCUAUC | 3559 | GAUAGGCACAGGACAGGAG | 3560 |
| UCCUGUCCUGUGCCUAUCA | 3561 | UGAUAGGCACAGGACAGGA | 3562 |
| GUGCCUAUCACAUUUGCAG | 3563 | CUGCAAAUGUGAUAGGCAC | 3564 |
| CUAUCACAUUUGCAGAGGG | 3565 | CCCUCUGCAAAUGUGAUAG | 3566 |
| UAUCACAUUUGCAGAGGGU | 3567 | ACCCUCUGCAAAUGUGAUA | 3568 |
| AUCACAUUUGCAGAGGGUA | 3569 | UACCCUCUGCAAAUGUGAU | 3570 |
| UCACAUUUGCAGAGGGUAA | 3571 | UUACCCUCUGCAAAUGUGA | 3572 |
| CACAUUUGCAGAGGGUAAG | 3573 | CUUACCCUCUGCAAAUGUG | 3574 |
| ACAUUUGCAGAGGGUAAGA | 3575 | UCUUACCCUCUGCAAAUGU | 3576 |
| CUCACCCUGCUCCUUCCCA | 3577 | UGGGAAGGAGCAGGGUGAG | 3578 |
| CACCCUGCUCCUUCCCAUC | 3579 | GAUGGGAAGGAGCAGGGUG | 3580 |
| CCUGCUCCUUCCCAUCACC | 3581 | GGUGAUGGGAAGGAGCAGG | 3582 |
| UGCUCCUUCCCAUCACCAA | 3583 | UUGGUGAUGGGAAGGAGCA | 3584 |
| CAGUAAGAUUCCCUGGUGG | 3585 | CCACCAGGGAAUCUUACUG | 3586 |
| AGUAAGAUUCCCUGGUGGU | 3587 | ACCACCAGGGAAUCUUACU | 3588 |
| GUAAGAUUCCCUGGUGGUG | 3589 | CACCACCAGGGAAUCUUAC | 3590 |
| UAAGAUUCCCUGGUGGUGG | 3591 | CCACCACCAGGGAAUCUUA | 3592 |
| AAGAUUCCCUGGUGGUGGA | 3593 | UCCACCACCAGGGAAUCUU | 3594 |
| UCCCUGGUGGUGGAAGGAA | 3595 | UUCCUUCCACCACCAGGGA | 3596 |
| UCUGCUGAAUCCUGGUCCU | 3597 | AGGACCAGGAUUCAGCAGA | 3598 |
| CUGCUGAAUCCUGGUCCUG | 3599 | CAGGACCAGGAUUCAGCAG | 3600 |
| UGCUGAAUCCUGGUCCUGC | 3601 | GCAGGACCAGGAUUCAGCA | 3602 |
| GCUGAAUCCUGGUCCUGCU | 3603 | AGCAGGACCAGGAUUCAGC | 3604 |
| CUGAAUCCUGGUCCUGCUU | 3603 | GAAGCAGGACCAGGAUUCA | 3604 |
| GAAUCCUGGUCCUGCUUCU | 3605 | AGAAGCAGGACCAGGAUUC | 3606 |
| AAUCCUGGUCCUGCUUCUG | 3607 | CAGAAGCAGGACCAGGAUU | 3608 |
| AUCCUGGUCCUGCUUCUGU | 3609 | ACAGAAGCAGGACCAGGAU | 3610 |

TABLE 8-continued

| Sense Sequence | SEQ ID NO: | Antisense Sequence | SEQ ID NO: |
|---|---|---|---|
| UCCUGGUCCUGCUUCUGUU | 3611 | AACAGAAGCAGGACCAGGA | 3612 |
| CCUGGUCCUGCUUCUGUUC | 3613 | GAACAGAAGCAGGACCAGG | 3614 |
| CUGGUCCUGCUUCUGUUCU | 3615 | AGAACAGAAGCAGGACCAG | 3616 |
| UUCUGUUCUCAUCCCUCCC | 3617 | GGGAGGGAUGAGAACAGAA | 3618 |
| CUUCUGCAGUGUGUAUGUU | 3619 | AACAUACACACUGCAGAAG | 3620 |
| UUCUGCAGUGUGUAUGUUG | 3621 | CAACAUACACACUGCAGAA | 3622 |
| UCUGCAGUGUGUAUGUUGC | 3623 | GCAACAUACACACUGCAGA | 3624 |
| CUGCAGUGUGUAUGUUGCC | 3625 | GGCAACAUACACACUGCAG | 3626 |
| UGCAGUGUGUAUGUUGCCU | 3627 | AGGCAACAUACACACUGCA | 3628 |
| GCAGUGUGUAUGUUGCCUG | 3629 | CAGGCAACAUACACACUGC | 3630 |
| CAGUGUGUAUGUUGCCUGG | 3631 | CCAGGCAACAUACACACUG | 3632 |
| AGUGUGUAUGUUGCCUGGU | 3633 | ACCAGGCAACAUACACACU | 3634 |
| GUGUGUAUGUUGCCUGGUC | 3635 | GACCAGGCAACAUACACAC | 3636 |
| UGUGUAUGUUGCCUGGUCU | 3637 | AGACCAGGCAACAUACACA | 3638 |
| GUGUAUGUUGCCUGGUCUC | 3639 | GAGACCAGGCAACAUACAC | 3640 |
| UGUAUGUUGCCUGGUCUCU | 3641 | AGAGACCAGGCAACAUACA | 3642 |
| GUAUGUUGCCUGGUCUCUC | 3643 | GAGAGACCAGGCAACAUAC | 3644 |
| UAUGUUGCCUGGUCUCUCU | 3645 | AGAGAGACCAGGCAACAUA | 3646 |
| AUGUUGCCUGGUCUCUCUG | 3647 | CAGAGAGACCAGGCAACAU | 3648 |
| UGUUGCCUGGUCUCUCUGG | 3649 | CCAGAGAGACCAGGCAACA | 3650 |
| GUUGCCUGGUCUCUCUGGC | 3651 | GCCAGAGAGACCAGGCAAC | 3652 |
| UUGCCUGGUCUCUCUGGCC | 3653 | GGCCAGAGAGACCAGGCAA | 3654 |
| CUGGUCUCUCUGGCCUGCA | 3655 | UGCAGGCCAGAGAGACCAG | 3656 |
| CCUGCAGAGGUGACCCAAA | 3657 | UUUGGGUCACCUCUGCAGG | 3658 |
| CUGCCUUAUCCUUGCCUGU | 3659 | ACAGGCAAGGAUAAGGCAG | 3660 |
| UGCCUUAUCCUUGCCUGUU | 3661 | AACAGGCAAGGAUAAGGCA | 3662 |
| GCCUUAUCCUUGCCUGUUU | 3663 | AAACAGGCAAGGAUAAGGC | 3664 |
| AGUCUCCUGGUCCGGCUGA | 3665 | UCAGCCGGACCAGGAGACU | 3666 |
| GUCAAUGACAGCUUUUCCA | 3667 | UGGAAAAGCUGUCAUUGAC | 3668 |
| UGACAGCUUUUCCAUGUAA | 3669 | UUACAUGGAAAAGCUGUCA | 3670 |
| GACAGCUUUUCCAUGUAAG | 3671 | CUUACAUGGAAAAGCUGUC | 3672 |
| ACAGCUUUUCCAUGUAAGG | 3673 | CCUUACAUGGAAAAGCUGU | 3674 |
| CAGCUUUUCCAUGUAAGGC | 3675 | GCCUUACAUGGAAAAGCUG | 3676 |
| AGCUUUUCCAUGUAAGGCA | 3677 | UGCCUUACAUGGAAAAGCU | 3678 |
| UGUAAGGCAUGGUGCUAGG | 3679 | CCUAGCACCAUGCCUUACA | 3680 |
| GUAAGGCAUGGUGCUAGGU | 3681 | ACCUAGCACCAUGCCUUAC | 3682 |
| UAAGGCAUGGUGCUAGGUU | 3683 | AACCUAGCACCAUGCCUUA | 3684 |
| GCAUGGUGCUAGGUUCCAG | 3685 | CUGGAACCUAGCACCAUGC | 3686 |
| CAUGGUGCUAGGUUCCAGG | 3687 | CCUGGAACCUAGCACCAUG | 3688 |
| AUGGUGCUAGGUUCCAGGA | 3689 | UCCUGGAACCUAGCACCAU | 3690 |
| UGGUGCUAGGUUCCAGGAG | 3691 | CUCCUGGAACCUAGCACCA | 3692 |
| GGUGCUAGGUUCCAGGAGG | 3693 | CCUCCUGGAACCUAGCACC | 3694 |
| GUGCUAGGUUCCAGGAGGA | 3695 | UCCUCCUGGAACCUAGCAC | 3696 |
| UGCAUGGAGGCAUAAUGGU | 3697 | ACCAUUAUGCCUCCAUGCA | 3698 |
| GCAUGGAGGCAUAAUGGUU | 3699 | AACCAUUAUGCCUCCAUGC | 3700 |
| CAUGGAGGCAUAAUGGUUA | 3701 | UAACCAUUAUGCCUCCAUG | 3702 |
| AUGGAGGCAUAAUGGUUAG | 3703 | CUAACCAUUAUGCCUCCAU | 3704 |
| UGGAGGCAUAAUGGUUAGG | 3705 | CCUAACCAUUAUGCCUCCA | 3706 |
| GGAGGCAUAAUGGUUAGGG | 3707 | CCCUAACCAUUAUGCCUCC | 3708 |
| GAGGCAUAAUGGUUAGGGA | 3709 | UCCCUAACCAUUAUGCCUC | 3710 |
| CAUAAUGGUUAGGGAGUCA | 3711 | UGACUCCCUAACCAUUAUG | 3712 |
| AUAAUGGUUAGGGAGUCAU | 3713 | AUGACUCCCUAACCAUUAU | 3714 |
| UAAUGGUUAGGGAGUCAUG | 3715 | CAUGACUCCCUAACCAUUA | 3716 |
| GGUUAGGGAGUCAUGACAC | 3717 | GUGUCAUGACUCCCUAACC | 3718 |
| CAUUACCAGGCUGCACCAG | 3719 | CUGGUGCAGCCUGGUAAUG | 3720 |
| AUUACCAGGCUGCACCAGG | 3721 | CCUGGUGCAGCCUGGUAAU | 3722 |
| UACCAGGCUGCACCAGGAU | 3723 | AUCCUGGUGCAGCCUGGUA | 3724 |
| ACCAGGCUGCACCAGGAUA | 3725 | UAUCCUGGUGCAGCCUGGU | 3726 |
| CCAGGCUGCACCAGGAUAC | 3727 | GUAUCCUGGUGCAGCCUGG | 3728 |
| AAAGGAUGAGUAGGGACAU | 3729 | AUGUCCCUACUCAUCCUUU | 3730 |
| AAGGAUGAGUAGGGACAUA | 3731 | UAUGUCCCUACUCAUCCUU | 3732 |
| AGGAUGAGUAGGGACAUAC | 3733 | GUAUGUCCCUACUCAUCCU | 3734 |
| GUAGGGACAUACUAAGAAG | 3735 | CUUCUUAGUAUGUCCCUAC | 3736 |
| GGACAUACUAAGAAGCAGC | 3737 | GCUGCUUCUUAGUAUGUCC | 3738 |
| AUACUAAGAAGCAGCCCUC | 3739 | GAGGGCUGCUUCUUAGUAU | 3740 |
| UACUAAGAAGCAGCCCUCU | 3741 | AGAGGGCUGCUUCUUAGUA | 3742 |
| ACUAAGAAGCAGCCCUCUC | 3743 | GAGAGGGCUGCUUCUUAGU | 3744 |
| AGAAGCAGCCCUCUCCUCU | 3745 | AGAGGAGAGGGCUGCUUCU | 3746 |
| GAAGCAGCCCUCUCCUCUU | 3747 | AAGAGGAGAGGGCUGCUUC | 3748 |
| CAGCCCUCUCCUCUUGGAA | 3749 | UUCCAAGAGGAGAGGGCUG | 3750 |
| GCCUGGCAGAUGGAUAGAG | 3751 | CUCUAUCCAUCUGCCAGGC | 3752 |
| CCUGGCAGAUGGAUAGAGC | 3753 | GCUCUAUCCAUCUGCCAGG | 3754 |
| CUGGCAGAUGGAUAGAGCU | 3755 | AGCUCUAUCCAUCUGCCAG | 3756 |
| UGGCAGAUGGAUAGAGCUG | 3757 | CAGCUCUAUCCAUCUGCCA | 3758 |
| GGCAGAUGGAUAGAGCUGG | 3759 | CCAGCUCUAUCCAUCUGCC | 3760 |
| GCAGAUGGAUAGAGCUGGG | 3761 | CCCAGCUCUAUCCAUCUGC | 3762 |

TABLE 8-continued

| Sense Sequence | SEQ ID NO: | Antisense Sequence | SEQ ID NO: |
|---|---|---|---|
| AAAGGCCUCUGCUCAAGUA | 3763 | UACUUGAGCAGAGGCCUUU | 3764 |
| AAGGCCUCUGCUCAAGUAA | 3765 | UUACUUGAGCAGAGGCCUU | 3766 |
| AGGCCUCUGCUCAAGUAAC | 3767 | GUUACUUGAGCAGAGGCCU | 3768 |
| CAGGAGCACUGUCUUAGUU | 3769 | AACUAAGACAGUGCUCCUG | 3770 |
| AGGAGCACUGUCUUAGUUU | 3771 | AAACUAAGACAGUGCUCCU | 3772 |
| GGAGCACUGUCUUAGUUUG | 3773 | CAAACUAAGACAGUGCUCC | 3774 |
| GAGCACUGUCUUAGUUUGG | 3775 | CCAAACUAAGACAGUGCUC | 3776 |
| AGCACUGUCUUAGUUUGGG | 3777 | CCCAAACUAAGACAGUGCU | 3778 |
| GUUCUUCCAAAGCAGAGCU | 3779 | AGCUCUGCUUUGGAAGAAC | 3780 |
| AGCAGAGCUUGAGCUAAGG | 3781 | CCUUAGCUCAAGCUCUGCU | 3782 |
| GCAGAGCUUGAGCUAAGGG | 3783 | CCCUUAGCUCAAGCUCUGC | 3784 |
| CAGAGCUUGAGCUAAGGGC | 3785 | GCCCUUAGCUCAAGCUCUG | 3786 |
| GCUUGAGCUAAGGGCUUGG | 3787 | CCAAGCCCUUAGCUCAAGC | 3788 |
| UUGAGCUAAGGGCUUGGGU | 3789 | ACCCAAGCCCUUAGCUCAA | 3790 |
| UGAGCUAAGGGCUUGGGUA | 3791 | UACCCAAGCCCUUAGCUCA | 3792 |
| GAGCUAAGGGCUUGGGUAC | 3793 | GUACCCAAGCCCUUAGCUC | 3794 |
| AGCUAAGGGCUUGGGUACA | 3795 | UGUACCCAAGCCCUUAGCU | 3796 |
| GCUAAGGGCUUGGGUACAG | 3797 | CUGUACCCAAGCCCUUAGC | 3798 |
| AGGGCUUGGGUACAGGUGA | 3799 | UCACCUGUACCCAAGCCCU | 3800 |
| GGGCUUGGGUACAGGUGAU | 3801 | AUCACCUGUACCCAAGCCC | 3802 |
| GGCUUGGGUACAGGUGAUC | 3803 | GAUCACCUGUACCCAAGCC | 3804 |
| GCUUGGGUACAGGUGAUCC | 3805 | GGAUCACCUGUACCCAAGC | 3806 |
| AGGUGAUCCUGUAUUCUUG | 3807 | CAAGAAUACAGGAUCACCU | 3808 |
| GGUGAUCCUGUAUUCUUGA | 3809 | UCAAGAAUACAGGAUCACC | 3810 |
| GUGAUCCUGUAUUCUUGAG | 3811 | CUCAAGAAUACAGGAUCAC | 3812 |
| UGAUCCUGUAUUCUUGAGC | 3813 | GCUCAAGAAUACAGGAUCA | 3814 |
| UCCUGUAUUCUUGAGCUAA | 3815 | UUAGCUCAAGAAUACAGGA | 3816 |
| CCUGUAUUCUUGAGCUAAG | 3817 | CUUAGCUCAAGAAUACAGG | 3818 |
| UGUAUUCUUGAGCUAAGGG | 3819 | CCCUUAGCUCAAGAAUACA | 3820 |
| GUAUUCUUGAGCUAAGGGC | 3821 | GCCCUUAGCUCAAGAAUAC | 3822 |
| UCUUGAGCUAAGGGCUUGG | 3823 | CCAAGCCCUUAGCUCAAGA | 3824 |
| UUGAGCUAAGGGCUUGGGU | 3825 | ACCCAAGCCCUUAGCUCAA | 3826 |
| UGAGCUAAGGGCUUGGGUA | 3827 | UACCCAAGCCCUUAGCUCA | 3828 |
| GAGCUAAGGGCUUGGGUAC | 3829 | GUACCCAAGCCCUUAGCUC | 3830 |
| AGCUAAGGGCUUGGGUACA | 3831 | UGUACCCAAGCCCUUAGCU | 3832 |
| GCUAAGGGCUUGGGUACAG | 3833 | CUGUACCCAAGCCCUUAGC | 3834 |
| AGGGCUUGGGUACAGGUGA | 3835 | UCACCUGUACCCAAGCCCU | 3836 |
| GGGCUUGGGUACAGGUGAU | 3837 | AUCACCUGUACCCAAGCCC | 3838 |
| GGCUUGGGUACAGGUGAUC | 3839 | GAUCACCUGUACCCAAGCC | 3840 |
| GCUUGGGUACAGGUGAUCC | 3841 | GGAUCACCUGUACCCAAGC | 3842 |
| AGGUGAUCCUGUAUUGGG | 3843 | CCCAAAUACAGGAUCACCU | 3844 |
| GGUGAUCCUGUAUUGGGA | 3845 | UCCCAAAUACAGGAUCACC | 3846 |
| AUCCUGUAUUGGGAGGUU | 3847 | AACCUCCCAAAUACAGGAU | 3848 |
| UCCUGUAUUGGGAGGUUA | 3849 | UAACCUCCCAAAUACAGGA | 3850 |
| CCUGUAUUGGGAGGUUAA | 3851 | UUAACCUCCCAAAUACAGG | 3852 |
| CUGUAUUGGGAGGUUAAC | 3853 | GUUAACCUCCCAAAUACAG | 3854 |
| UGUAUUGGGAGGUUAACU | 3855 | AGUUAACCUCCCAAAUACA | 3856 |
| GUAUUGGGAGGUUAACUC | 3857 | GAGUUAACCUCCCAAAUAC | 3858 |
| UAUUGGGAGGUUAACUCA | 3859 | UGAGUUAACCUCCCAAAUA | 3860 |
| GGAGGUUAACUCAGGAAGU | 3861 | ACUUCCUGAGUUAACCUCC | 3862 |
| GAGGUUAACUCAGGAAGUG | 3863 | CACUUCCUGAGUUAACCUC | 3864 |
| AGGUUAACUCAGGAAGUGA | 3865 | UCACUUCCUGAGUUAACCU | 3866 |
| UCAGGAAGUGAGGGCAUAA | 3867 | UUAUGCCCUCACUUCCUGA | 3868 |
| CAGGAAGUGAGGGCAUAAG | 3869 | CUUAUGCCCUCACUUCCUG | 3870 |
| AGGAAGUGAGGGCAUAAGG | 3871 | CCUUAUGCCCUCACUUCCU | 3872 |
| GGAAGUGAGGGCAUAAGGU | 3873 | ACCUUAUGCCCUCACUUCC | 3874 |
| GAAGUGAGGGCAUAAGGUA | 3875 | UACCUUAUGCCCUCACUUC | 3876 |
| AAGUGAGGGCAUAAGGUAA | 3877 | UUACCUUAUGCCCUCACUU | 3878 |
| AGUGAGGGCAUAAGGUAAA | 3879 | UUUACCUUAUGCCCUCACU | 3880 |
| AAAGCCAUUAAGAGUAUGU | 3881 | ACAUACUCUUAAUGGCUUU | 3882 |
| AAGCCAUUAAGAGUAUGUU | 3883 | AACAUACUCUUAAUGGCUU | 3884 |
| AGCCAUUAAGAGUAUGUUA | 3885 | UAACAUACUCUUAAUGGCU | 3886 |
| UAAGAGUAUGUUAAGUCCC | 3887 | GGGACUUAACAUACUCUUA | 3888 |
| AAGAGUAUGUUAAGUCCCU | 3889 | AGGGACUUAACAUACUCUU | 3890 |
| AGAGUAUGUUAAGUCCCUU | 3891 | AAGGGACUUAACAUACUCU | 3892 |
| GAGUAUGUUAAGUCCCUUC | 3893 | GAAGGGACUUAACAUACUC | 3894 |
| AGUAUGUUAAGUCCCUUCA | 3895 | UGAAGGGACUUAACAUACU | 3896 |
| GUAUGUUAAGUCCCUUCAG | 3897 | CUGAAGGGACUUAACAUAC | 3898 |
| UAUGUUAAGUCCCUUCAGU | 3899 | ACUGAAGGGACUUAACAUA | 3900 |
| AUGUUAAGUCCCUUCAGUA | 3901 | UACUGAAGGGACUUAACAU | 3902 |
| UGUUAAGUCCCUUCAGUAG | 3903 | CUACUGAAGGGACUUAACA | 3904 |
| GUUAAGUCCCUUCAGUAGG | 3905 | CCUACUGAAGGGACUUAAC | 3906 |
| UUAAGUCCCUUCAGUAGGC | 3907 | GCCUACUGAAGGGACUUAA | 3908 |
| UAAGUCCCUUCAGUAGGCC | 3909 | GGCCUACUGAAGGGACUUA | 3910 |
| AAGUCCCUUCAGUAGGCCU | 3911 | AGGCCUACUGAAGGGACUU | 3912 |
| AGUCCCUUCAGUAGGCCUU | 3913 | AAGGCCUACUGAAGGGACU | 3914 |

TABLE 8-continued

| Sense Sequence | SEQ ID NO: | Antisense Sequence | SEQ ID NO: |
|---|---|---|---|
| GUCCCUUCAGUAGGCCUUG | 3915 | CAAGGCCUACUGAAGGGAC | 3916 |
| UCCCUUCAGUAGGCCUUGG | 3917 | CCAAGGCCUACUGAAGGGA | 3918 |
| CCCUUCAGUAGGCCUUGGG | 3919 | CCCAAGGCCUACUGAAGGG | 3920 |
| CCUUCAGUAGGCCUUGGGA | 3921 | UCCCAAGGCCUACUGAAGG | 3922 |
| CUUCAGUAGGCCUUGGGAA | 3923 | UUCCCAAGGCCUACUGAAG | 3924 |
| AAAAGUAUAGAUUGCCCAA | 3925 | UUGGGCAAUCUAUACUUUU | 3926 |
| AAAGUAUAGAUUGCCCAAG | 3927 | CUUGGGCAAUCUAUACUUU | 3928 |
| AAGUAUAGAUUGCCCAAGA | 3929 | UCUUGGGCAAUCUAUACUU | 3930 |
| AAAGACUGGCAGGGUGAUC | 3931 | GAUCACCCUGCCAGUCUUU | 3932 |
| AAGACUGGCAGGGUGAUCA | 3933 | UGAUCACCCUGCCAGUCUU | 3934 |
| CUGGCAGGGUGAUCAGUCC | 3935 | GGACUGAUCACCCUGCCAG | 3936 |
| GAAUGUACUUAAUGAGUGG | 3937 | CCACUCAUUAAGUACAUUC | 3938 |
| AAUGUACUUAAUGAGUGGG | 3939 | CCCACUCAUUAAGUACAUU | 3940 |
| UGUACUUAAUGAGUGGGCU | 3941 | AGCCCACUCAUUAAGUACA | 3942 |
| GUACUUAAUGAGUGGGCUA | 3943 | UAGCCCACUCAUUAAGUAC | 3944 |
| UACUUAAUGAGUGGGCUAC | 3945 | GUAGCCCACUCAUUAAGUA | 3946 |
| CUUAAUGAGUGGGCUACAG | 3947 | CUGUAGCCCACUCAUUAAG | 3948 |
| UAAUGAGUGGGCUACAGCG | 3949 | CGCUGUAGCCCACUCAUUA | 3950 |
| AAUGAGUGGGCUACAGCGU | 3951 | ACGCUGUAGCCCACUCAUU | 3952 |
| AUGAGUGGGCUACAGCGUA | 3953 | UACGCUGUAGCCCACUCAU | 3954 |
| UGAGUGGGCUACAGCGUAU | 3955 | AUACGCUGUAGCCCACUCA | 3956 |
| GAGUGGGCUACAGCGUAUC | 3957 | GAUACGCUGUAGCCCACUC | 3958 |
| AGUGGGCUACAGCGUAUCC | 3959 | GGAUACGCUGUAGCCCACU | 3960 |
| GUGGGCUACAGCGUAUCCU | 3961 | AGGAUACGCUGUAGCCCAC | 3962 |
| UGGGCUACAGCGUAUCCUC | 3963 | GAGGAUACGCUGUAGCCCA | 3964 |
| AGAGUUGUUCUACCUGGGU | 3965 | ACCCAGGUAGAACAACUCU | 3966 |
| GAGUUGUUCUACCUGGGUA | 3967 | UACCCAGGUAGAACAACUC | 3968 |
| AGUUGUUCUACCUGGGUAU | 3969 | AUACCCAGGUAGAACAACU | 3970 |
| GUUGUUCUACCUGGGUAUA | 3971 | UAUACCCAGGUAGAACAAC | 3972 |
| UUGUUCUACCUGGGUAUAU | 3973 | AUAUACCCAGGUAGAACAA | 3974 |
| UGUUCUACCUGGGUAUAUC | 3975 | GAUAUACCCAGGUAGAACA | 3976 |
| GUUCUACCUGGGUAUAUCC | 3977 | GGAUAUACCCAGGUAGAAC | 3978 |
| UACCUGGGUAUAUCCAAAA | 3979 | UUUUGGAUAUACCCAGGUA | 3980 |
| AGGGUAUGGAGUUUACGAG | 3981 | CUCGUAAACUCCAUACCCU | 3982 |
| GGGUAUGGAGUUUACGAGG | 3983 | CCUCGUAAACUCCAUACCC | 3984 |
| GGUAUGGAGUUUACGAGGG | 3985 | CCCUCGUAAACUCCAUACC | 3986 |
| GUAUGGAGUUUACGAGGGU | 3987 | ACCCUCGUAAACUCCAUAC | 3988 |
| UAUGGAGUUUACGAGGGUU | 3989 | AACCCUCGUAAACUCCAUA | 3990 |
| AUGGAGUUUACGAGGGUUC | 3991 | GAACCCUCGUAAACUCCAU | 3992 |
| UGGAGUUUACGAGGGUUCA | 3993 | UGAACCCUCGUAAACUCCA | 3994 |
| GGAGUUUACGAGGGUUCAA | 3995 | UUGAACCCUCGUAAACUCC | 3996 |
| GAGUUUACGAGGGUUCAAG | 3997 | CUUGAACCCUCGUAAACUC | 3998 |
| AGUUUACGAGGGUUCAAGG | 3999 | CCUUGAACCCUCGUAAACU | 4000 |
| GUUUACGAGGGUUCAAGGU | 4001 | ACCUUGAACCCUCGUAAAC | 4002 |
| UUUACGAGGGUUCAAGGUA | 4003 | UACCUUGAACCCUCGUAAA | 4004 |
| CGAGGGUUCAAGGUAUUUG | 4005 | CAAAUACCUUGAACCCUCG | 4006 |
| GAGGGUUCAAGGUAUUUGG | 4007 | CCAAAUACCUUGAACCCUC | 4008 |
| AGGGUUCAAGGUAUUUGGU | 4009 | ACCAAAUACCUUGAACCCU | 4010 |
| GGGUUCAAGGUAUUUGGUU | 4011 | AACCAAAUACCUUGAACCC | 4012 |
| GGUUCAAGGUAUUUGGUUC | 4013 | GAACCAAAUACCUUGAACC | 4014 |
| GUUCAAGGUAUUUGGUUCA | 4015 | UGAACCAAAUACCUUGAAC | 4016 |
| UUCAAGGUAUUUGGUUCAG | 4017 | CUGAACCAAAUACCUUGAA | 4018 |
| UCAAGGUAUUUGGUUCAGG | 4019 | CCUGAACCAAAUACCUUGA | 4020 |
| CAACUGGCCAGGUCACAGG | 4021 | CCUGUGACCUGGCCAGUUG | 4022 |
| GCCAGGUCACAGGGCAAUC | 4023 | GAUUGCCCUGUGACCUGGC | 4024 |
| CCAGGUCACAGGGCAAUCA | 4025 | UGAUUGCCCUGUGACCUGG | 4026 |
| AGGUCACAGGGCAAUCAAG | 4027 | CUUGAUUGCCCUGUGACCU | 4028 |
| GGUCACAGGGCAAUCAAGU | 4029 | ACUUGAUUGCCCUGUGACC | 4030 |
| GUCACAGGGCAAUCAAGUU | 4031 | AACUUGAUUGCCCUGUGAC | 4032 |
| UCAGGGCAAUCAAGUUA | 4033 | UAACUUGAUUGCCCUGUGA | 4034 |
| CACAGGGCAAUCAAGUUAC | 4035 | GUAACUUGAUUGCCCUGUG | 4036 |
| ACAGGGCAAUCAAGUUACU | 4037 | AGUAACUUGAUUGCCCUGU | 4038 |
| CAGGGCAAUCAAGUUACUC | 4039 | GAGUAACUUGAUUGCCCUG | 4040 |
| AGGGCAAUCAAGUUACUCU | 4041 | AGAGUAACUUGAUUGCCCU | 4042 |
| CAAUCAAGUUACUCUGUGU | 4043 | ACACAGAGUAACUUGAUUG | 4044 |
| AAUCAAGUUACUCUGUGUU | 4045 | AACACAGAGUAACUUGAUU | 4046 |
| AUCAAGUUACUCUGUGUUU | 4047 | AAACACAGAGUAACUUGAU | 4048 |
| ACUCUGUGUUUCUUUGUCA | 4049 | UGACAAAGAAACACAGAGU | 4050 |
| UCUGUGUUUCUUUGUCAGG | 4051 | CCUGACAAAGAAACACAGA | 4052 |
| UGUUUCUUUGUCAGGACAC | 4053 | GUGUCCUGACAAAGAAACA | 4054 |
| AAAGCAGGGAUUGUGUUCA | 4055 | UGAACACAAUCCCUGCUUU | 4056 |
| AAGCAGGGAUUGUGUUCAU | 4057 | AUGAACACAAUCCCUGCUU | 4058 |
| AGCAGGGAUUGUGUUCAUU | 4059 | AAUGAACACAAUCCCUGCU | 4060 |
| GCAGGGAUUGUGUUCAUUU | 4061 | AAAUGAACACAAUCCCUGC | 4062 |
| CAGGGAUUGUGUUCAUUUG | 4063 | CAAAUGAACACAAUCCCUG | 4064 |
| AGGGAUUGUGUUCAUUUGA | 4065 | UCAAAUGAACACAAUCCCU | 4066 |

TABLE 8-continued

| Sense Sequence | SEQ ID NO: | Antisense Sequence | SEQ ID NO: |
|---|---|---|---|
| GUGUUCAUUUGAGGGUUUC | 4067 | GAAACCCUCAAAUGAACAC | 4068 |
| UGUUCAUUUGAGGGUUUCA | 4069 | UGAAACCCUCAAAUGAACA | 4070 |
| GUUCAUUUGAGGGUUUCAC | 4071 | GUGAAACCCUCAAAUGAAC | 4072 |
| UUCAUUUGAGGGUUUCACU | 4073 | AGUGAAACCCUCAAAUGAA | 4074 |
| UCAUUUGAGGGUUUCACUG | 4075 | CAGUGAAACCCUCAAAUGA | 4076 |
| CAUUUGAGGGUUUCACUGU | 4077 | ACAGUGAAACCCUCAAAUG | 4078 |
| AGUCUCAGCUUCCAUGCAA | 4079 | UUGCAUGGAAGCUGAGACU | 4080 |
| UCUCAGCUUCCAUGCAACU | 4081 | AGUUGCAUGGAAGCUGAGA | 4082 |
| CUCAGCUUCCAUGCAACUG | 4083 | CAGUUGCAUGGAAGCUGAG | 4084 |
| UCAGCUUCCAUGCAACUGU | 4085 | ACAGUUGCAUGGAAGCUGA | 4086 |
| CAGCUUCCAUGCAACUGUC | 4087 | GACAGUUGCAUGGAAGCUG | 4088 |
| AGCUUCCAUGCAACUGUCC | 4089 | GGACAGUUGCAUGGAAGCU | 4090 |
| GCUUCCAUGCAACUGUCCA | 4091 | UGGACAGUUGCAUGGAAGC | 4092 |
| CUUCCAUGCAACUGUCCAU | 4093 | AUGGACAGUUGCAUGGAAG | 4094 |
| UUCCAUGCAACUGUCCAUC | 4095 | GAUGGACAGUUGCAUGGAA | 4096 |
| CCAUGCAACUGUCCAUCAC | 4097 | GUGAUGGACAGUUGCAUGG | 4098 |
| CAUGCAACUGUCCAUCACG | 4099 | CGUGAUGGACAGUUGCAUG | 4100 |
| AUGCAACUGUCCAUCACGG | 4101 | CCGUGAUGGACAGUUGCAU | 4102 |
| UGCAACUGUCCAUCACGGC | 4103 | GCCGUGAUGGACAGUUGCA | 4104 |
| GCAACUGUCCAUCACGGCU | 4105 | AGCCGUGAUGGACAGUUGC | 4106 |
| CAACUGUCCAUCACGGCUG | 4107 | CAGCCGUGAUGGACAGUUG | 4108 |
| AACUGUCCAUCACGGCUGC | 4109 | GCAGCCGUGAUGGACAGUU | 4110 |
| ACUGUCCAUCACGGCUGCA | 4111 | UGCAGCCGUGAUGGACAGU | 4112 |
| CUGUCCAUCACGGCUGCAA | 4113 | UUGCAGCCGUGAUGGACAG | 4114 |
| UGUCCAUCACGGCUGCAAC | 4115 | GUUGCAGCCGUGAUGGACA | 4116 |
| GUCCAUCACGGCUGCAACU | 4117 | AGUUGCAGCCGUGAUGGAC | 4118 |
| UCCAUCACGGCUGCAACUG | 4119 | CAGUUGCAGCCGUGAUGGA | 4120 |
| CCAUCACGGCUGCAACUGA | 4121 | UCAGUUGCAGCCGUGAUGG | 4122 |
| CAUCACGGCUGCAACUGAA | 4123 | UUCAGUUGCAGCCGUGAUG | 4124 |
| ACAGCGCACCAGAAGCUAA | 4125 | UUAGCUUCUGGUGCGCUGU | 4126 |
| CAGCGCACCAGAAGCUAAA | 4127 | UUUAGCUUCUGGUGCGCUG | 4128 |
| AGCGCACCAGAAGCUAAAG | 4129 | CUUUAGCUUCUGGUGCGCU | 4130 |
| GCGCACCAGAAGCUAAAGU | 4131 | ACUUUAGCUUCUGGUGCGC | 4132 |
| CGCACCAGAAGCUAAAGUC | 4133 | GACUUUAGCUUCUGGUGCG | 4134 |
| GCACCAGAAGCUAAAGUCU | 4135 | AGACUUUAGCUUCUGGUGC | 4136 |
| CACCAGAAGCUAAAGUCUU | 4137 | AAGACUUUAGCUUCUGGUG | 4138 |
| ACCAGAAGCUAAAGUCUUG | 4139 | CAAGACUUUAGCUUCUGGU | 4140 |
| CCAGAAGCUAAAGUCUUGA | 4141 | UCAAGACUUUAGCUUCUGG | 4142 |
| CAGAAGCUAAAGUCUUGAU | 4143 | AUCAAGACUUUAGCUUCUG | 4144 |
| AGAAGCUAAAGUCUUGAUG | 4145 | CAUCAAGACUUUAGCUUCU | 4146 |
| GAAGCUAAAGUCUUGAUGC | 4147 | GCAUCAAGACUUUAGCUUC | 4148 |
| AAGCUAAAGUCUUGAUGCC | 4149 | GGCAUCAAGACUUUAGCUU | 4150 |
| AGCUAAAGUCUUGAUGCCA | 4151 | UGGCAUCAAGACUUUAGCU | 4152 |
| CCCAUUCACAUCUCUGUCA | 4153 | UGACAGAGAUGUGAAUGGG | 4154 |
| UUCACAUCUCUGUCACGUC | 4155 | GACGUGACAGAGAUGUGAA | 4156 |
| UCACAUCUCUGUCACGUCC | 4157 | GGACGUGACAGAGAUGUGA | 4158 |
| CACAUCUCUGUCACGUCCA | 4159 | UGGACGUGACAGAGAUGUG | 4160 |
| UCUCUGUCACGUCCACUAA | 4161 | UUAGUGGACGUGACAGAGA | 4162 |
| CUCUGUCACGUCCACUAAU | 4163 | AUUAGUGGACGUGACAGAG | 4164 |
| UCUGUCACGUCCACUAAUC | 4165 | GAUUAGUGGACGUGACAGA | 4166 |
| CUGUCACGUCCACUAAUCG | 4167 | CGAUUAGUGGACGUGACAG | 4168 |
| UGUCACGUCCACUAAUCGG | 4169 | CCGAUUAGUGGACGUGACA | 4170 |
| GUCACGUCCACUAAUCGGC | 4171 | GCCGAUUAGUGGACGUGAC | 4172 |
| UCACGUCCACUAAUCGGCA | 4173 | UGCCGAUUAGUGGACGUGA | 4174 |
| CACGUCCACUAAUCGGCAA | 4175 | UUGCCGAUUAGUGGACGUG | 4176 |
| ACGUCCACUAAUCGGCAAA | 4177 | UUUGCCGAUUAGUGGACGU | 4178 |
| CGUCCACUAAUCGGCAAAA | 4179 | UUUUGCCGAUUAGUGGACG | 4180 |
| GUCCACUAAUCGGCAAAAG | 4181 | CUUUUGCCGAUUAGUGGAC | 4182 |
| UCCACUAAUCGGCAAAAGG | 4183 | CCUUUUGCCGAUUAGUGGA | 4184 |
| CCACUAAUCGGCAAAAGGA | 4185 | UCCUUUUGCCGAUUAGUGG | 4186 |
| CACUAAUCGGCAAAAGGAG | 4187 | CUCCUUUUGCCGAUUAGUG | 4188 |
| AGAAGAUGACCUAAGUGUG | 4189 | CACACUUAGGUCAUCUUCU | 4190 |
| GAAGAUGACCUAAGUGUGA | 4191 | UCACACUUAGGUCAUCUUC | 4192 |
| AAGAUGACCUAAGUGUGAC | 4193 | GUCACACUUAGGUCAUCUU | 4194 |
| AGAUGACCUAAGUGUGACU | 4195 | AGUCACACUUAGGUCAUCU | 4196 |
| GAUGACCUAAGUGUGACUG | 4197 | CAGUCACACUUAGGUCAUC | 4198 |
| AUGACCUAAGUGUGACUGC | 4199 | GCAGUCACACUUAGGUCAU | 4200 |
| UGACCUAAGUGUGACUGCA | 4201 | UGCAGUCACACUUAGGUCA | 4202 |
| AAAAUGAAGCCAGAGCAGU | 4203 | ACUGCUCUGGCUUCAUUUU | 4204 |
| UCCGACCAAGGAGGAAGGA | 4205 | UCCUUCCUCCUUGGUCGGA | 4206 |
| CCGACCAAGGAGGAAGGAA | 4207 | UUCCUUCCUCCUUGGUCGG | 4208 |
| AGAGCAGGUAAGCAGGAAG | 4209 | CUUCCUGCUUACCUGCUCU | 4210 |
| GAGCAGGUAAGCAGGAAGG | 4211 | CCUUCCUGCUUACCUGCUC | 4212 |
| AGGUAAGCAGGAAGGCCAG | 4213 | CUGGCCUUCCUGCUUACCU | 4214 |
| AGCAGGAAGGCCAGUGUCC | 4215 | GGACACUGGCCUUCCUGCU | 4216 |
| CAGGAAGGCCAGUGUCCCA | 4217 | UGGGACACUGGCCUUCCUG | 4218 |

TABLE 8-continued

| Sense Sequence | SEQ ID NO: | Antisense Sequence | SEQ ID NO: |
|---|---|---|---|
| UCCCAGACAGGACCCUAAU | 4219 | AUUAGGGUCCUGUCUGGGA | 4220 |
| CCCAGACAGGACCCUAAUG | 4221 | CAUUAGGGUCCUGUCUGGG | 4222 |
| CCAGACAGGACCCUAAUGA | 4223 | UCAUUAGGGUCCUGUCUGG | 4224 |
| CAGACAGGACCCUAAUGAU | 4225 | AUCAUUAGGGUCCUGUCUG | 4226 |
| AGACAGGACCCUAAUGAUC | 4227 | GAUCAUUAGGGUCCUGUCU | 4228 |
| GACAGGACCCUAAUGAUCC | 4229 | GGAUCAUUAGGGUCCUGUC | 4230 |
| GGACCCUAAUGAUCCUGAA | 4231 | UUCAGGAUCAUUAGGGUCC | 4232 |
| CCUAAUGAUCCUGAAUCCA | 4233 | UGGAUUCAGGAUCAUUAGG | 4234 |
| CUAAUGAUCCUGAAUCCAU | 4235 | AUGGAUUCAGGAUCAUUAG | 4236 |
| UGAUCCUGAAUCCAUGUAU | 4237 | AUACAUGGAUUCAGGAUCA | 4238 |
| GAUCCUGAAUCCAUGUAUC | 4239 | GAUACAUGGAUUCAGGAUC | 4240 |
| AUCCUGAAUCCAUGUAUCA | 4241 | UGAUACAUGGAUUCAGGAU | 4242 |
| UCCAUGUAUCAGGAUCCAU | 4243 | AUGGAUCCUGAUACAUGGA | 4244 |
| CCAUGUAUCAGGAUCCAUC | 4245 | GAUGGAUCCUGAUACAUGG | 4246 |
| CAUGUAUCAGGAUCCAUCC | 4247 | GGAUGGAUCCUGAUACAUG | 4248 |
| UCACCUCUCAUUUUCCAAA | 4249 | UUUGGAAAAUGAGAGGUGA | 4250 |
| UCCAAAGCCCUGCCAUGCU | 4251 | AGCAUGGCAGGGCUUUGGA | 4252 |
| CCAAAGCCCUGCCAUGCUG | 4253 | CAGCAUGGCAGGGCUUUGG | 4254 |
| CAUGCUGCCAUCCCACUUC | 4255 | GAAGUGGGAUGGCAGCAUG | 4256 |
| AUGCUGCCAUCCCACUUCC | 4257 | GGAAGUGGGAUGGCAGCAU | 4258 |
| UGCUGCCAUCCCACUUCCC | 4259 | GGGAAGUGGGAUGGCAGCA | 4260 |
| CGGGUUCCCUUUUCCUAAA | 4261 | UUUAGGAAAAGGGAACCCG | 4262 |
| AGCUGCAGCUUAUGGCUUC | 4263 | GAAGCCAUAAGCUGCAGCU | 4264 |
| GCUGCAGCUUAUGGCUUCU | 4265 | AGAAGCCAUAAGCUGCAGC | 4266 |
| CUGCAGCUUAUGGCUUCUC | 4267 | GAGAAGCCAUAAGCUGCAG | 4268 |
| UGCAGCUUAUGGCUUCUCC | 4269 | GGAGAAGCCAUAAGCUGCA | 4270 |
| GCAGCUUAUGGCUUCUCCA | 4271 | UGGAGAAGCCAUAAGCUGC | 4272 |
| CAGCUUAUGGCUUCUCCAG | 4273 | CUGGAGAAGCCAUAAGCUG | 4274 |
| AGCUUAUGGCUUCUCCAGU | 4275 | ACUGGAGAAGCCAUAAGCU | 4276 |
| GCUUAUGGCUUCUCCAGUA | 4277 | UACUGGAGAAGCCAUAAGC | 4278 |
| CUUAUGGCUUCUCCAGUAG | 4279 | CUACUGGAGAAGCCAUAAG | 4280 |
| UUAUGGCUUCUCCAGUAGG | 4281 | CCUACUGGAGAAGCCAUAA | 4282 |
| UAUGGCUUCUCCAGUAGGU | 4283 | ACCUACUGGAGAAGCCAUA | 4284 |
| AUGGCUUCUCCAGUAGGUG | 4285 | CACCUACUGGAGAAGCCAU | 4286 |
| UGGCUUCUCCAGUAGGUGG | 4287 | CCACCUACUGGAGAAGCCA | 4288 |
| GGCUUCUCCAGUAGGUGGC | 4289 | GCCACCUACUGGAGAAGCC | 4290 |
| GCUUCUCCAGUAGGUGGCA | 4291 | UGCCACCUACUGGAGAAGC | 4292 |
| CUUCUCCAGUAGGUGGCAG | 4293 | CUGCCACCUACUGGAGAAG | 4294 |
| UUCUCCAGUAGGUGGCAGC | 4295 | GCUGCCACCUACUGGAGAA | 4296 |
| UCUCCAGUAGGUGGCAGCA | 4297 | UGCUGCCACCUACUGGAGA | 4298 |
| CUCCAGUAGGUGGCAGCAC | 4299 | GUGCUGCCACCUACUGGAG | 4300 |
| ACACCAGAAGUCACAUUUC | 4301 | GAAAUGUGACUUCUGGUGU | 4302 |
| GAAGUCACAUUUCAUCCUU | 4303 | AAGGAUGAAAUGUGACUUC | 4304 |
| AAGUCACAUUUCAUCCUUU | 4305 | AAAGGAUGAAAUGUGACUU | 4306 |
| AGUCACAUUUCAUCCUUUU | 4307 | AAAAGGAUGAAAUGUGACU | 4308 |
| UUUCAUCCUUUUACAUGGU | 4309 | ACCAUGUAAAAGGAUGAAA | 4310 |
| UUCAUCCUUUUACAUGGUU | 4311 | AACCAUGUAAAAGGAUGAA | 4312 |
| UCAUCCUUUUACAUGGUUC | 4313 | GAACCAUGUAAAAGGAUGA | 4314 |
| CAUCCUUUUACAUGGUUCC | 4315 | GGAACCAUGUAAAAGGAUG | 4316 |
| UGGUUCCCAUCUACCCUCA | 4317 | UGAGGGUAGAUGGGAACCA | 4318 |
| GGUUCCCAUCUACCCUCAC | 4319 | GUGAGGGUAGAUGGGAACC | 4320 |
| GUUCCCAUCUACCCUCACA | 4321 | UGUGAGGGUAGAUGGGAAC | 4322 |
| GGCAAUUCUUCCUCCAGGA | 4323 | UCCUGGAGGAAGAAUUGCC | 4324 |
| GCAAUUCUUCCUCCAGGAC | 4325 | GUCCUGGAGGAAGAAUUGC | 4326 |
| CAAUUCUUCCUCCAGGACC | 4327 | GGUCCUGGAGGAAGAAUUG | 4328 |
| AAUUCUUCCUCCAGGACCC | 4329 | GGGUCCUGGAGGAAGAAUU | 4330 |
| CCCUUGGACUUUGCCCUUC | 4331 | GAAGGGCAAAGUCCAAGGG | 4332 |
| CCUUGGACUUUGCCCUUCU | 4333 | AGAAGGGCAAAGUCCAAGG | 4334 |
| CUUGGACUUUGCCCUUCUU | 4335 | AAGAAGGGCAAAGUCCAAG | 4336 |
| UUGGACUUUGCCCUUCUUA | 4337 | UAAGAAGGGCAAAGUCCAA | 4338 |
| UGGACUUUGCCCUUCUUAC | 4339 | GUAAGAAGGGCAAAGUCCA | 4340 |
| GGACUUUGCCCUUCUUACU | 4341 | AGUAAGAAGGGCAAAGUCC | 4342 |
| UUUGCCCUUCUUACUGGCC | 4343 | GGCCAGUAAGAAGGGCAAA | 4344 |
| UUGCCCUUCUUACUGGCCA | 4345 | UGGCCAGUAAGAAGGGCAA | 4346 |
| UGCCCUUCUUACUGGCCAG | 4347 | CUGGCCAGUAAGAAGGGCA | 4348 |
| UCUUACUGGCCAGGCAGGG | 4349 | CCCUGCCUGGCCAGUAAGA | 4350 |
| GGCCAGAGUCCAGGCUUGA | 4351 | UCAAGCCUGGACUCUGGCC | 4352 |
| GCCAGAGUCCAGGCUUGAC | 4353 | GUCAAGCCUGGACUCUGGC | 4354 |
| GUCCAGGCUUGACUCAUUC | 4355 | GAAUGAGUCAAGCCUGGAC | 4356 |
| AGGCUUGACUCAUUCCCAC | 4357 | GUGGGAAUGAGUCAAGCCU | 4358 |
| GACUCAUUCCCACCUUGUC | 4359 | GACAAGGUGGGAAUGAGUC | 4360 |
| ACUCAUUCCCACCUUGUCC | 4361 | GGACAAGGUGGGAAUGAGU | 4362 |
| UCAUUCCCACCUUGUCCUG | 4363 | CAGGACAAGGUGGGAAUGA | 4364 |
| CACCUUGUCCUGGGCUGAG | 4365 | CUCAGCCCAGGACAAGGUG | 4366 |
| ACCACCCAGCCCAGAAGUU | 4367 | AACUUCUGGGCUGGGUGGU | 4368 |
| CCACCCAGCCCAGAAGUUC | 4369 | GAACUUCUGGGCUGGGUGG | 4370 |

TABLE 8-continued

| Sense Sequence | SEQ ID NO: | Antisense Sequence | SEQ ID NO: |
|---|---|---|---|
| CACCCAGCCCAGAAGUUCC | 4371 | GGAACUUCUGGGCUGGGUG | 4372 |
| ACCCAGCCCAGAAGUUCCA | 4373 | UGGAACUUCUGGGCUGGGU | 4374 |
| CCAGAAGUUCCAGGGAAGG | 4375 | CCUUCCCUGGAACUUCUGG | 4376 |
| CAGAAGUUCCAGGGAAGGA | 4377 | UCCUUCCCUGGAACUUCUG | 4378 |
| AACUCUCCGGUCCACCAUG | 4379 | CAUGGUGGACCGGAGAGUU | 4380 |
| ACUCUCCGGUCCACCAUGG | 4381 | CCAUGGUGGACCGGAGAGU | 4382 |
| CACCAUGGAGUACCUCUCA | 4383 | UGAGAGGUACUCCAUGGUG | 4384 |
| ACCAUGGAGUACCUCUCAG | 4385 | CUGAGAGGUACUCCAUGGU | 4386 |
| UGGAGUACCUCUCAGCUCU | 4387 | AGAGCUGAGAGGUACUCCA | 4388 |
| GGAGUACCUCUCAGCUCUG | 4389 | CAGAGCUGAGAGGUACUCC | 4390 |
| GAGUACCUCUCAGCUCUGA | 4391 | UCAGAGCUGAGAGGUACUC | 4392 |
| AGUACCUCUCAGCUCUGAA | 4393 | UUCAGAGCUGAGAGGUACU | 4394 |
| CCAGUGACUUACUCAGGUG | 4395 | CACCUGAGUAAGUCACUGG | 4396 |
| CAGUGACUUACUCAGGUGA | 4397 | UCACCUGAGUAAGUCACUG | 4398 |
| AGUGACUUACUCAGGUGAC | 4399 | GUCACCUGAGUAAGUCACU | 4400 |
| GUGACUUACUCAGGUGACU | 4401 | AGUCACCUGAGUAAGUCAC | 4402 |
| UGACUUACUCAGGUGACUG | 4403 | CAGUCACCUGAGUAAGUCA | 4404 |
| GACUUACUCAGGUGACUGC | 4405 | GCAGUCACCUGAGUAAGUC | 4406 |
| ACUUACUCAGGUGACUGCU | 4407 | AGCAGUCACCUGAGUAAGU | 4408 |
| CUUACUCAGGUGACUGCUA | 4409 | UAGCAGUCACCUGAGUAAG | 4410 |
| UUACUCAGGUGACUGCUAA | 4411 | UUAGCAGUCACCUGAGUAA | 4412 |
| UACUCAGGUGACUGCUAAC | 4413 | GUUAGCAGUCACCUGAGUA | 4414 |
| ACUCAGGUGACUGCUAACC | 4415 | GGUUAGCAGUCACCUGAGU | 4416 |
| CUCAGGUGACUGCUAACCC | 4417 | GGGUUAGCAGUCACCUGAG | 4418 |
| GGUGACUGCUAACCCUCCG | 4419 | CGGAGGGUUAGCAGUCACC | 4420 |
| GUGACUGCUAACCCUCCGC | 4421 | GCGGAGGGUUAGCAGUCAC | 4422 |
| UGACUGCUAACCCUCCGCU | 4423 | AGCGGAGGGUUAGCAGUCA | 4424 |
| GACUGCUAACCCUCCGCUC | 4425 | GAGCGGAGGGUUAGCAGUC | 4426 |
| ACUGCUAACCCUCCGCUCU | 4427 | AGAGCGGAGGGUUAGCAGU | 4428 |
| CUGCUAACCCUCCGCUCUA | 4429 | UAGAGCGGAGGGUUAGCAG | 4430 |
| UGCUAACCCUCCGCUCUAC | 4431 | GUAGAGCGGAGGGUUAGCA | 4432 |
| AACCCUCCGCUCUACCCUC | 4433 | GAGGGUAGAGCGGAGGGUU | 4434 |
| ACUCCACAGUGGGCUUGUC | 4435 | GACAAGCCCACUGUGGAGU | 4436 |
| CUCCACAGUGGGCUUGUCA | 4437 | UGACAAGCCCACUGUGGAG | 4438 |
| UCCACAGUGGGCUUGUCAA | 4439 | UUGACAAGCCCACUGUGGA | 4440 |
| CCACAGUGGGCUUGUCAAG | 4441 | CUUGACAAGCCCACUGUGG | 4442 |
| GUCAAGCUCCUGAGCCACC | 4443 | GGUGGCUCAGGAGCUUGAC | 4444 |
| CCAUGGUCUCUCCCUCAUC | 4445 | GAUGAGGGAGAGACCAUGG | 4446 |
| CAUGGUCUCUCCCUCAUCC | 4447 | GGAUGAGGGAGAGACCAUG | 4448 |
| AUGGUCUCUCCCUCAUCCC | 4449 | GGGAUGAGGGAGAGACCAU | 4450 |
| UCUCUCCCUCAUCCCUAAU | 4451 | AUUAGGGAUGAGGGAGAGA | 4452 |
| CUCUCCCUCAUCCCUAAUC | 4453 | GAUUAGGGAUGAGGGAGAG | 4454 |
| UCUCCCUCAUCCCUAAUCG | 4455 | CGAUUAGGGAUGAGGGAGA | 4456 |
| CUCCCUCAUCCCUAAUCGA | 4457 | UCGAUUAGGGAUGAGGGAG | 4458 |
| UCCCUCAUCCCUAAUCGAU | 4459 | AUCGAUUAGGGAUGAGGGA | 4460 |
| CCCUCAUCCCUAAUCGAUA | 4461 | UAUCGAUUAGGGAUGAGGG | 4462 |
| CCUCAUCCCUAAUCGAUAA | 4463 | UUAUCGAUUAGGGAUGAGG | 4464 |
| CUCAUCCCUAAUCGAUAAA | 4465 | UUUAUCGAUUAGGGAUGAG | 4466 |
| AACCUAGAUCUCUCCCUCC | 4467 | GGAGGGAGAGAUCUAGGUU | 4468 |
| ACCUAGAUCUCUCCCUCCC | 4469 | GGGAGGGAGAGAUCUAGGU | 4470 |
| CUAGAUCUCUCCCUCCCUA | 4471 | UAGGGAGGGAGAGAUCUAG | 4472 |
| UAGAUCUCUCCCUCCCUAG | 4473 | CUAGGGAGGGAGAGAUCUA | 4474 |
| AGAUCUCUCCCUCCCUAGC | 4475 | GCUAGGGAGGGAGAGAUCU | 4476 |
| GAUCUCUCCCUCCCUAGCC | 4477 | GGCUAGGGAGGGAGAGAUC | 4478 |
| AUCUCUCCCUCCCUAGCCC | 4479 | GGGCUAGGGAGGGAGAGAU | 4480 |
| UAGCCCUCUAGCCACUCUA | 4481 | UAGAGUGGCUAGAGGGCUA | 4482 |
| AGCCCUCUAGCCACUCUAC | 4483 | GUAGAGUGGCUAGAGGGCU | 4484 |
| CUCUAGCCACUCUACCCUC | 4485 | GAGGGUAGAGUGGCUAGAG | 4486 |
| UCUAGCCACUCUACCCUCA | 4487 | UGAGGGUAGAGUGGCUAGA | 4488 |
| CUAGCCACUCUACCCUCAU | 4489 | AUGAGGGUAGAGUGGCUAG | 4490 |
| UAGCCACUCUACCCUCAUC | 4491 | GAUGAGGGUAGAGUGGCUA | 4492 |
| AGCCACUCUACCCUCAUCA | 4493 | UGAUGAGGGUAGAGUGGCU | 4494 |
| GCCACUCUACCCUCAUCAU | 4495 | AUGAUGAGGGUAGAGUGGC | 4496 |
| CCACUCUACCCUCAUCAUG | 4497 | CAUGAUGAGGGUAGAGUGG | 4498 |
| CACUCUACCCUCAUCAUGC | 4499 | GCAUGAUGAGGGUAGAGUG | 4500 |
| ACUCUACCCUCAUCAUGCC | 4501 | GGCAUGAUGAGGGUAGAGU | 4502 |
| CUCUACCCUCAUCAUGCCC | 4503 | GGGCAUGAUGAGGGUAGAG | 4504 |
| UCUACCCUCAUCAUGCCCU | 4505 | AGGGCAUGAUGAGGGUAGA | 4506 |
| CUACCCUCAUCAUGCCCUU | 4507 | AAGGGCAUGAUGAGGGUAG | 4508 |
| UACCCUCAUCAUGCCCUUU | 4509 | AAAGGGCAUGAUGAGGGUA | 4510 |
| ACCCUCAUCAUGCCCUUUA | 4511 | UAAAGGGCAUGAUGAGGGU | 4512 |
| CCCUCAUCAUGCCCUUUAC | 4513 | GUAAAGGGCAUGAUGAGGG | 4514 |
| CUCAUCAUGCCCUUUACAC | 4515 | GUGUAAAGGGCAUGAUGAG | 4516 |
| UCAUCAUGCCCUUUACACU | 4517 | AGUGUAAAGGGCAUGAUGA | 4518 |
| CCCUUCUUGACUUUUCUUC | 4519 | GAAGAAAAGUCAAGAAGGG | 4520 |
| CUUCUUGACUUUUCUUCUC | 4521 | GAGAAGAAAAGUCAAGAAG | 4522 |

TABLE 8-continued

| Sense Sequence | SEQ ID NO: | Antisense Sequence | SEQ ID NO: |
|---|---|---|---|
| GACUUUUCUUCUCAACUAC | 4523 | GUAGUUGAGAAGAAAAGUC | 4524 |
| ACUUUUCUUCUCAACUACC | 4525 | GGUAGUUGAGAAGAAAAGU | 4526 |
| CUUUUCUUCUCAACUACCA | 4527 | UGGUAGUUGAGAAGAAAAG | 4528 |
| UUUUCUUCUCAACUACCAG | 4529 | CUGGUAGUUGAGAAGAAAA | 4530 |
| UAUCUAAUAUAAGCUCGGA | 4531 | UCCGAGCUUAUAUUAGAUA | 4532 |
| AUCUAAUAUAAGCUCGGAG | 4533 | CUCCGAGCUUAUAUUAGAU | 4534 |
| UCUAAUAUAAGCUCGGAGU | 4535 | ACUCCGAGCUUAUAUUAGA | 4536 |
| CUAAUAUAAGCUCGGAGUU | 4537 | AACUCCGAGCUUAUAUUAG | 4538 |
| UAAUAUAAGCUCGGAGUUU | 4539 | AAACUCCGAGCUUAUAUUA | 4540 |
| AAUAUAAGCUCGGAGUUUG | 4541 | CAAACUCCGAGCUUAUAUU | 4542 |
| AUAUAAGCUCGGAGUUUGG | 4543 | CCAAACUCCGAGCUUAUAU | 4544 |
| UAUAAGCUCGGAGUUUGGA | 4545 | UCCAAACUCCGAGCUUAUA | 4546 |
| AUAAGCUCGGAGUUUGGAC | 4547 | GUCCAAACUCCGAGCUUAU | 4548 |
| UAAGCUCGGAGUUUGGACG | 4549 | CGUCCAAACUCCGAGCUUA | 4550 |
| AAGCUCGGAGUUUGGACGG | 4551 | CCGUCCAAACUCCGAGCUU | 4552 |
| AGCUCGGAGUUUGGACGGA | 4553 | UCCGUCCAAACUCCGAGCU | 4554 |
| GCUCGGAGUUUGGACGGAG | 4555 | CUCCGUCCAAACUCCGAGC | 4556 |
| CUCGGAGUUUGGACGGAGG | 4557 | CCUCCGUCCAAACUCCGAG | 4558 |
| UCGGAGUUUGGACGGAGGG | 4559 | CCCUCCGUCCAAACUCCGA | 4560 |
| CGGAGUUUGGACGGAGGGU | 4561 | ACCCUCCGUCCAAACUCCG | 4562 |
| UUUGGACGGAGGGUCUGGA | 4563 | UCCAGACCCUCCGUCCAAA | 4564 |
| CCCAGCGACCUUUCCGUGU | 4565 | ACACGGAAAGGUCGCUGGG | 4566 |
| CCAGCGACCUUUCCGUGUC | 4567 | GACACGGAAAGGUCGCUGG | 4568 |
| CAGCGACCUUUCCGUGUCU | 4569 | AGACACGGAAAGGUCGCUG | 4570 |
| AGCGACCUUUCCGUGUCUG | 4571 | CAGACACGGAAAGGUCGCU | 4572 |
| GCGACCUUUCCGUGUCUGU | 4573 | ACAGACACGGAAAGGUCGC | 4574 |
| CGACCUUUCCGUGUCUGUG | 4575 | CACAGACACGGAAAGGUCG | 4576 |
| CUUUCCGUGUCUGUGAUCA | 4577 | UGAUCACAGACACGGAAAG | 4578 |
| UUUCCGUGUCUGUGAUCAC | 4579 | GUGAUCACAGACACGGAAA | 4580 |
| UUCCGUGUCUGUGAUCACA | 4581 | UGUGAUCACAGACACGGAA | 4582 |
| AAGGCCUGACAGCUGCCAC | 4583 | GUGGCAGCUGUCAGGCCUU | 4584 |
| GCCAGGAGCUGCUAGCCAA | 4585 | UUGGCUAGCAGCUCCUGGC | 4586 |
| CCAGGAGCUGCUAGCCAAA | 4587 | UUUGGCUAGCAGCUCCUGG | 4588 |
| GAGCUGCUAGCCAAAGUAA | 4589 | UUACUUUGGCUAGCAGCUC | 4590 |
| AGCUGCUAGCCAAAGUAAG | 4591 | CUUACUUUGGCUAGCAGCU | 4592 |
| GCUGCUAGCCAAAGUAAGU | 4593 | ACUUACUUUGGCUAGCAGC | 4594 |
| CUGCUAGCCAAAGUAAGUA | 4595 | UACUUACUUUGGCUAGCAG | 4596 |
| UGCUAGCCAAAGUAAGUAG | 4597 | CUACUUACUUUGGCUAGCA | 4598 |
| GCUAGCCAAAGUAAGUAGG | 4599 | CCUACUUACUUUGGCUAGC | 4600 |
| UAGCCAAAGUAAGUAGGCC | 4601 | GGCCUACUUACUUUGGCUA | 4602 |
| AGCCAAAGUAAGUAGGCCA | 4603 | UGGCCUACUUACUUUGGCU | 4604 |
| GCCAAAGUAAGUAGGCCAA | 4605 | UUGGCCUACUUACUUUGGC | 4606 |
| CCAAAGUAAGUAGGCCAAG | 4607 | CUUGGCCUACUUACUUUGG | 4608 |
| CAAAGUAAGUAGGCCAAGU | 4609 | ACUUGGCCUACUUACUUUG | 4610 |
| AAAGUAAGUAGGCCAAGUU | 4611 | AACUUGGCCUACUUACUUU | 4612 |
| AAGUAAGUAGGCCAAGUUC | 4613 | GAACUUGGCCUACUUACUU | 4614 |
| AGUAAGUAGGCCAAGUUCC | 4615 | GGAACUUGGCCUACUUACU | 4616 |
| GUAAGUAGGCCAAGUUCCU | 4617 | AGGAACUUGGCCUACUUAC | 4618 |
| UAAGUAGGCCAAGUUCCUC | 4619 | GAGGAACUUGGCCUACUUA | 4620 |
| UAGGCCAAGUUCCUCGGUU | 4621 | AACCGAGGAACUUGGCCUA | 4622 |
| AGGCCAAGUUCCUCGGUUC | 4623 | GAACCGAGGAACUUGGCCU | 4624 |
| GGCCAAGUUCCUCGGUUCC | 4625 | GGAACCGAGGAACUUGGCC | 4626 |
| GCCAAGUUCCUCGGUUCCU | 4627 | AGGAACCGAGGAACUUGGC | 4628 |
| CCAAGUUCCUCGGUUCCUA | 4629 | UAGGAACCGAGGAACUUGG | 4630 |
| CAAGUUCCUCGGUUCCUAU | 4631 | AUAGGAACCGAGGAACUUG | 4632 |
| AAGUUCCUCGGUUCCUAUA | 4633 | UAUAGGAACCGAGGAACUU | 4634 |
| AGUUCCUCGGUUCCUAUAG | 4635 | CUAUAGGAACCGAGGAACU | 4636 |
| GUUCCUCGGUUCCUAUAGC | 4637 | GCUAUAGGAACCGAGGAAC | 4638 |
| UUCCUCGGUUCCUAUAGCA | 4639 | UGCUAUAGGAACCGAGGAA | 4640 |
| UCCUCGGUUCCUAUAGCAG | 4641 | CUGCUAUAGGAACCGAGGA | 4642 |
| CAGUGGCAACUUGUGAUGA | 4643 | UCAUCACAAGUUGCCACUG | 4644 |
| AGUGGCAACUUGUGAUGAU | 4645 | AUCAUCACAAGUUGCCACU | 4646 |
| GUGGCAACUUGUGAUGAUG | 4647 | CAUCAUCACAAGUUGCCAC | 4648 |
| GGCAACUUGUGAUGAUGGA | 4649 | UCCAUCAUCACAAGUUGCC | 4650 |
| ACUUGUGAUGAUGGAGCAG | 4651 | CUGCUCCAUCAUCACAAGU | 4652 |
| CUUGUGAUGAUGGAGCAGA | 4663 | UCUGCUCCAUCAUCACAAG | 4654 |
| GUGAUGAUGGAGCAGAGGG | 4666 | CCCUCUGCUCCAUCAUCAC | 4656 |
| UGAUGAUGGAGCAGAGGGC | 4667 | GCCCUCUGCUCCAUCAUCA | 4658 |
| UGGAGCAGAGGGCUGAAGU | 4659 | ACUUCAGCCCUCUGCUCCA | 4660 |
| GGAGCAGAGGGCUGAAGUC | 4661 | GACUUCAGCCCUCUGCUCC | 4662 |
| GAGCAGAGGGCUGAAGUCA | 4663 | UGACUUCAGCCCUCUGCUC | 4664 |
| CUAAAAGCAGCGGAGUGGG | 4665 | CCCACUCCGCUGCUUUUAG | 4666 |
| UAAAAGCAGCGGAGUGGGC | 4667 | GCCCACUCCGCUGCUUUUA | 4668 |
| AAAAGCAGCGGAGUGGGCC | 4669 | GGCCCACUCCGCUGCUUUU | 4670 |
| AAAGCAGCGGAGUGGGCCU | 4671 | AGGCCCACUCCGCUGCUUU | 4672 |
| AAGCAGCGGAGUGGGCCUA | 4673 | UAGGCCCACUCCGCUGCUU | 4674 |

TABLE 8-continued

| Sense Sequence | SEQ ID NO: | Antisense Sequence | SEQ ID NO: |
|---|---|---|---|
| AGCAGCGGAGUGGGCCUAA | 4675 | UUAGGCCCACUCCGCUGCU | 4676 |
| GCAGCGGAGUGGGCCUAAU | 4677 | AUUAGGCCCACUCCGCUGC | 4678 |
| CAGCGGAGUGGGCCUAAUG | 4679 | CAUUAGGCCCACUCCGCUG | 4680 |
| AGCGGAGUGGGCCUAAUGA | 4681 | UCAUUAGGCCCACUCCGCU | 4682 |
| GCGGAGUGGGCCUAAUGAG | 4683 | CUCAUUAGGCCCACUCCGC | 4684 |
| AGUGGGCCUAAUGAGCUCU | 4685 | AGAGCUCAUUAGGCCCACU | 4686 |
| GUGGGCCUAAUGAGCUCUG | 4687 | CAGAGCUCAUUAGGCCCAC | 4688 |
| UGGGCCUAAUGAGCUCUGG | 4689 | CCAGAGCUCAUUAGGCCCA | 4690 |
| GGGCCUAAUGAGCUCUGGU | 4691 | ACCAGAGCUCAUUAGGCCC | 4692 |
| GGCCUAAUGAGCUCUGGUC | 4693 | GACCAGAGCUCAUUAGGCC | 4694 |
| GCCUAAUGAGCUCUGGUCA | 4695 | UGACCAGAGCUCAUUAGGC | 4696 |
| CCUAAUGAGCUCUGGUCAA | 4697 | UUGACCAGAGCUCAUUAGG | 4698 |
| CUAAUGAGCUCUGGUCAAU | 4699 | AUUGACCAGAGCUCAUUAG | 4700 |
| UAAUGAGCUCUGGUCAAUU | 4701 | AAUUGACCAGAGCUCAUUA | 4702 |
| AAUGAGCUCUGGUCAAUUU | 4703 | AAAUUGACCAGAGCUCAUU | 4704 |
| AUGAGCUCUGGUCAAUUUG | 4705 | CAAAUUGACCAGAGCUCAU | 4706 |
| UGAGCUCUGGUCAAUUUGU | 4707 | ACAAAUUGACCAGAGCUCA | 4708 |
| CUGGUCAAUUUGUUCAUUU | 4709 | AAAUGAACAAAUUGACCAG | 4710 |
| CAAUUUGUUCAUUUCCAC | 4711 | GUGGAAAUGAACAAAUUG | 4712 |
| AGUGAGCUUUUCUAUGGGA | 4713 | UCCCAUAGAAAAGCUCACU | 4714 |
| AGCUUUUCUAUGGGAGCAG | 4715 | CUGCUCCCAUAGAAAAGCU | 4716 |
| GAAUUCAGAAGCUAGUAUG | 4717 | CAUACUAGCUUCUGAAUUC | 4718 |
| AUUCAGAAGCUAGUAUGGA | 4719 | UCCAUACUAGCUUCUGAAU | 4720 |
| UUCAGAAGCUAGUAUGGAA | 4721 | UUCCAUACUAGCUUCUGAA | 4722 |
| AAAGGUGAUUUGUGUGACA | 4728 | UGUCACACAAAUCACCUUU | 4724 |
| AUUCUGAUUCUGCCACUUC | 4725 | GAAGUGGCAGAAUCAGAAU | 4726 |
| AUUCUGCCACUUCCUGCCU | 4727 | AGGCAGGAAGUGGCAGAAU | 4728 |
| GCCACUUCCUGCCUGUCAA | 4729 | UUGACAGGCAGGAAGUGGC | 4730 |
| CCACUUCCUGCCUGUCAAA | 4731 | UUUGACAGGCAGGAAGUGG | 4732 |
| AACCUUGGGAAGUUGUUCA | 4733 | UGAACAACUUCCCAAGGUU | 4734 |
| ACCUUGGGAAGUUGUUCAA | 4735 | UUGAACAACUUCCCAAGGU | 4736 |
| CCUUGGGAAGUUGUUCAAC | 4737 | GUUGAACAACUUCCCAAGG | 4738 |
| GGGAAGUUGUUCAACCUAC | 4739 | GUAGGUUGAACAACUUCCC | 4740 |
| GGAAGUUGUUCAACCUACC | 4741 | GGUAGGUUGAACAACUUCC | 4742 |
| GAAGUUGUUCAACCUACCA | 4743 | UGGUAGGUUGAACAACUUC | 4744 |
| AAGUUGUUCAACCUACCAA | 4745 | UUGGUAGGUUGAACAACUU | 4746 |
| AGUUGUUCAACCUACCAAA | 4747 | UUUGGUAGGUUGAACAACU | 4748 |
| GUUGUUCAACCUACCAAAA | 4749 | UUUUGGUAGGUUGAACAAC | 4750 |
| GCAAUAAUAAUACAUCACC | 4751 | GGUGAUGUAUUAUUAUUGC | 4752 |
| AUAAUAAUACAUCACCUCC | 4753 | GGAGGUGAUGUAUUAUUAU | 4754 |
| UAAUACAUCACCUCCUAGG | 4755 | CCUAGGAGGUGAUGUAUUA | 4756 |
| AAUACAUCACCUCCUAGGG | 4757 | CCCUAGGAGGUGAUGUAUU | 4758 |
| AUACAUCACCUCCUAGGGU | 4759 | ACCCUAGGAGGUGAUGUAU | 4760 |
| UACAUCACCUCCUAGGGUU | 4761 | AACCCUAGGAGGUGAUGUA | 4762 |
| ACAUCACCUCCUAGGGUUG | 4763 | CAACCCUAGGAGGUGAUGU | 4764 |
| AAAGGAGUAAGAGGAUAAU | 4765 | AUUAUCCUCUUACUCCUUU | 4766 |
| AAGGAGUAAGAGGAUAAUG | 4767 | CAUUAUCCUCUUACUCCUU | 4768 |
| AGUAAGAGGAUAAUGUAGG | 4769 | CCUACAUUAUCCUCUUACU | 4770 |
| GUAAGAGGAUAAUGUAGGU | 4771 | ACCUACAUUAUCCUCUUAC | 4772 |
| UAAGAGGAUAAUGUAGGUA | 4778 | UACCUACAUUAUCCUCUUA | 4774 |
| AAGAGGAUAAUGUAGGUAA | 4776 | UUACCUACAUUAUCCUCUU | 4776 |
| AGAGGAUAAUGUAGGUAAA | 4777 | UUUACCUACAUUAUCCUCU | 4778 |
| GAGGAUAAUGUAGGUAAAG | 4779 | CUUUACCUACAUUAUCCUC | 4780 |
| GGAUAAUGUAGGUAAAGUC | 4781 | GACUUUACCUACAUUAUCC | 4782 |
| AUAAUGUAGGUAAAGUCCU | 4783 | AGGACUUUACCUACAUUAU | 4784 |
| GUAGGUAAAGUCCUCAUAC | 4785 | GUAUGAGGACUUUACCUAC | 4786 |
| GUAAAGUCCUCAUACCUGG | 4787 | CCAGGUAUGAGGACUUUAC | 4788 |
| UAAAGUCCUCAUACCUGGC | 4789 | GCCAGGUAUGAGGACUUUA | 4790 |
| AAAGUCCUCAUACCUGGCA | 4791 | UGCCAGGUAUGAGGACUUU | 4792 |
| AAGUCCUCAUACCUGGCAC | 4793 | GUGCCAGGUAUGAGGACUU | 4794 |
| AGUCCUCAUACCUGGCACA | 4795 | UGUGCCAGGUAUGAGGACU | 4796 |
| GUCCUCAUACCUGGCACAG | 4797 | CUGUGCCAGGUAUGAGGAC | 4798 |
| UCCUCAUACCUGGCACAGA | 4799 | UCUGUGCCAGGUAUGAGGA | 4800 |
| UCUUGAGGGUGUGGGAAGU | 4801 | ACUUCCCACACCCUCAAGA | 4802 |
| CUUGAGGGUGUGGGAAGUG | 4803 | CACUUCCCACACCCUCAAG | 4804 |
| UUGAGGGUGUGGGAAGUGA | 4805 | UCACUUCCCACACCCUCAA | 4806 |
| UGAGGGUGUGGGAAGUGAG | 4807 | CUCACUUCCCACACCCUCA | 4808 |
| AGGGUGUGGGAAGUGAGGU | 4809 | ACCUCACUUCCCACACCCU | 4810 |
| GGGUGUGGGAAGUGAGGUG | 4811 | CACCUCACUUCCCACACCC | 4812 |
| GGGAAGUGAGGUGCAGCAU | 4813 | AUGCUGCACCUCACUUCCC | 4814 |
| GGAAGUGAGGUGCAGCAUU | 4815 | AAUGCUGCACCUCACUUCC | 4816 |
| GAAGUGAGGUGCAGCAUUG | 4817 | CAAUGCUGCACCUCACUUC | 4818 |
| AAGUGAGGUGCAGCAUUGU | 4819 | ACAAUGCUGCACCUCACUU | 4820 |
| AGUGAGGUGCAGCAUUGUA | 4821 | UACAAUGCUGCACCUCACU | 4822 |
| GUGAGGUGCAGCAUUGUAG | 4823 | CUACAAUGCUGCACCUCAC | 4824 |
| UGAGGUGCAGCAUUGUAGA | 4825 | UCUACAAUGCUGCACCUCA | 4826 |

TABLE 8-continued

| Sense Sequence | SEQ ID NO: | Antisense Sequence | SEQ ID NO: |
|---|---|---|---|
| GAGGUGCAGCAUUGUAGAU | 4827 | AUCUACAAUGCUGCACCUC | 4828 |
| AGGUGCAGCAUUGUAGAUA | 4829 | UAUCUACAAUGCUGCACCU | 4830 |
| GGUGCAGCAUUGUAGAUAA | 4831 | UUAUCUACAAUGCUGCACC | 4832 |
| GUGCAGCAUUGUAGAUAAG | 4833 | CUUAUCUACAAUGCUGCAC | 4834 |
| UGCAGCAUUGUAGAUAAGA | 4835 | UCUUAUCUACAAUGCUGCA | 4836 |
| GCAUUGUAGAUAAGACAGA | 4837 | UCUGUCUUAUCUACAAUGC | 4838 |
| CAUUGUAGAUAAGACAGAA | 4839 | UUCUGUCUUAUCUACAAUG | 4840 |
| AUUGUAGAUAAGACAGAAG | 4841 | CUUCUGUCUUAUCUACAAU | 4842 |
| AUAAGACAGAAGGGUGGAC | 4843 | GUCCACCCUUCUGUCUUAU | 4844 |
| UAAGACAGAAGGGUGGACU | 4845 | AGUCCACCCUUCUGUCUUA | 4846 |
| AACCUGGCUUGCUUUCCAA | 4847 | UUGGAAAGCAAGCCAGGUU | 4848 |
| CCUGGCUUGCUUUCCAAUU | 4849 | AAUUGGAAAGCAAGCCAGG | 4850 |
| ACCAGAAGUGACUUGGAGG | 4851 | CCUCCAAGUCACUUCUGGU | 4852 |
| CCAGAAGUGACUUGGAGGG | 4853 | CCCUCCAAGUCACUUCUGG | 4854 |
| AGAUGCCAAUGACAUGGUA | 4855 | UACCAUGUCAUUGGCAUCU | 4856 |
| GAUGCCAAUGACAUGGUAG | 4857 | CUACCAUGUCAUUGGCAUC | 4858 |
| AUGCCAAUGACAUGGUAGG | 4859 | CCUACCAUGUCAUUGGCAU | 4860 |
| CAAUGACAUGGUAGGAGCA | 4861 | UGCUCCUACCAUGUCAUUG | 4862 |
| AAUGACAUGGUAGGAGCAA | 4863 | UUGCUCCUACCAUGUCAUU | 4864 |
| AUGACAUGGUAGGAGCAAA | 4865 | UUUGCUCCUACCAUGUCAU | 4866 |
| UGACAUGGUAGGAGCAAAG | 4867 | CUUUGCUCCUACCAUGUCA | 4868 |
| GACAUGGUAGGAGCAAAGA | 4869 | UCUUUGCUCCUACCAUGUC | 4870 |
| AAAAGGUCAGCCUCUAGCU | 4871 | AGCUAGAGGCUGACCUUUU | 4872 |
| AAAGGUCAGCCUCUAGCUA | 4873 | UAGCUAGAGGCUGACCUUU | 4874 |
| AGGUCAGCCUCUAGCUAGG | 4875 | CCUAGCUAGAGGCUGACCU | 4876 |
| GGUCAGCCUCUAGCUAGGA | 4877 | UCCUAGCUAGAGGCUGACC | 4878 |
| GUCAGCCUCUAGCUAGGAU | 4879 | AUCCUAGCUAGAGGCUGAC | 4880 |
| CAGCCUCUAGCUAGGAUCC | 4881 | GGAUCCUAGCUAGAGGCUG | 4882 |
| AGCCUCUAGCUAGGAUCCC | 4883 | GGGAUCCUAGCUAGAGGCU | 4884 |
| AGAGCUGCAACCUUUAGGA | 4885 | UCCUAAAGGUUGCAGCUCU | 4886 |
| GAGCUGCAACCUUUAGGAG | 4887 | CUCCUAAAGGUUGCAGCUC | 4888 |
| AGCUGCAACCUUUAGGAGG | 4889 | CCUCCUAAAGGUUGCAGCU | 4890 |
| UUUAGGAGGUAUCAAAGUG | 4891 | CACUUUGAUACCUCCUAAA | 4892 |
| UUAGGAGGUAUCAAAGUGC | 4893 | GCACUUUGAUACCUCCUAA | 4894 |
| UAGGAGGUAUCAAAGUGCC | 4895 | GGCACUUUGAUACCUCCUA | 4896 |
| GUCAAAGUGGGACAUCGAC | 4897 | GUCGAUGUCCCACUUUGAC | 4898 |
| CAUCGACCAAUGUCUAGAG | 4899 | CUCUAGACAUUGGUCGAUG | 4900 |
| AUCGACCAAUGUCUAGAGC | 4901 | GCUCUAGACAUUGGUCGAU | 4902 |
| ACCAAUGUCUAGAGCCAAC | 4903 | GUUGGCUCUAGACAUUGGU | 4904 |
| CAAUGUCUAGAGCCAACUG | 4905 | CAGUUGGCUCUAGACAUUG | 4906 |
| AAUGUCUAGAGCCAACUGA | 4907 | UCAGUUGGCUCUAGACAUU | 4908 |
| AUGUCUAGAGCCAACUGAU | 4909 | AUCAGUUGGCUCUAGACAU | 4910 |
| UGUCUAGAGCCAACUGAUG | 4911 | CAUCAGUUGGCUCUAGACA | 4912 |
| GUCUAGAGCCAACUGAUGG | 4913 | CCAUCAGUUGGCUCUAGAC | 4914 |
| UCUAGAGCCAACUGAUGGA | 4915 | UCCAUCAGUUGGCUCUAGA | 4916 |
| CUAGAGCCAACUGAUGGAU | 4917 | AUCCAUCAGUUGGCUCUAG | 4918 |
| UAGAGCCAACUGAUGGAUG | 4919 | CAUCCAUCAGUUGGCUCUA | 4920 |
| AGAGCCAACUGAUGGAUGU | 4921 | ACAUCCAUCAGUUGGCUCU | 4922 |
| GAGCCAACUGAUGGAUGUU | 4923 | AACAUCCAUCAGUUGGCUC | 4924 |
| AACUGAUGGAUGUUGGGCA | 4925 | UGCCCAACAUCCAUCAGUU | 4926 |
| UGGAUGUUGGGCAGCUAAA | 4927 | UUUAGCUGCCCAACAUCCA | 4928 |
| GGAUGUUGGGCAGCUAAAG | 4929 | CUUUAGCUGCCCAACAUCC | 4930 |
| GAUGUUGGGCAGCUAAAGA | 4931 | UCUUUAGCUGCCCAACAUC | 4932 |
| UUGGGCAGCUAAAGAGGGA | 4933 | UCCCUCUUUAGCUGCCCAA | 4934 |
| UGGGCAGCUAAAGAGGGAA | 4935 | UUCCCUCUUUAGCUGCCCA | 4936 |
| GGGCAGCUAAAGAGGGAAG | 4937 | CUUCCCUCUUUAGCUGCCC | 4938 |
| GGCAGCUAAAGAGGGAAGG | 4939 | CCUUCCCUCUUUAGCUGCC | 4940 |
| GCAGCUAAAGAGGGAAGGG | 4941 | CCCUUCCCUCUUUAGCUGC | 4942 |
| GGGCAUGGGAUAAGACCUG | 4943 | CAGGUCUUAUCCCAUGCCC | 4944 |
| GGCAUGGGAUAAGACCUGC | 4945 | GCAGGUCUUAUCCCAUGCC | 4946 |
| GCAUGGGAUAAGACCUGCC | 4947 | GGCAGGUCUUAUCCCAUGC | 4948 |
| CAUGGGAUAAGACCUGCCC | 4949 | GGGCAGGUCUUAUCCCAUG | 4950 |
| AUGGGAUAAGACCUGCCCU | 4951 | AGGGCAGGUCUUAUCCCAU | 4952 |
| UGGGAUAAGACCUGCCCUU | 4953 | AAGGGCAGGUCUUAUCCCA | 4954 |
| GGGAUAAGACCUGCCCUUC | 4955 | GAAGGGCAGGUCUUAUCCC | 4956 |
| GGAUAAGACCUGCCCUUCU | 4957 | AGAAGGGCAGGUCUUAUCC | 4958 |
| AGACCUGCCCUUCUUGCUU | 4959 | AAGCAAGAAGGGCAGGUCU | 4960 |
| GACCUGCCCUUCUUGCUUC | 4961 | GAAGCAAGAAGGGCAGGUC | 4962 |
| CCUGCCCUUCUUGCUUCUU | 4963 | AAGAAGCAAGAAGGGCAGG | 4964 |
| CUGCCCUUCUUGCUUCUUG | 4965 | CAAGAAGCAAGAAGGGCAG | 4966 |
| UGCCCUUCUUGCUUCUUGC | 4967 | GCAAGAAGCAAGAAGGGCA | 4968 |
| UCUUGCUUCUUGCCAUUGG | 4969 | CCAAUGGCAAGAAGCAAGA | 4970 |
| CUUGCUUCUUGCCAUUGGG | 4971 | CCCAAUGGCAAGAAGCAAG | 4972 |
| UUGCUUCUUGCCAUUGGGC | 4973 | GCCCAAUGGCAAGAAGCAA | 4974 |
| CCAUUGGGCAGGCAUUGGA | 4975 | UCCAAUGCCUGCCCAAUGG | 4976 |
| CAUUGGGCAGGCAUUGGAG | 4977 | CUCCAAUGCCUGCCCAAUG | 4978 |

TABLE 8-continued

| Sense Sequence | SEQ ID NO: | Antisense Sequence | SEQ ID NO: |
|---|---|---|---|
| GACCCUACUGCUGAAUGGA | 4979 | UCCAUUCAGCAGUAGGGUC | 4980 |
| UACUGCUGAAUGGAGUGCU | 4981 | AGCACUCCAUUCAGCAGUA | 4982 |
| ACUGCUGAAUGGAGUGCUA | 4983 | UAGCACUCCAUUCAGCAGU | 4984 |
| CUGCUGAAUGGAGUGCUAA | 4985 | UUAGCACUCCAUUCAGCAG | 4986 |
| UGCUGAAUGGAGUGCUAAC | 4987 | GUUAGCACUCCAUUCAGCA | 4988 |
| GCUGAAUGGAGUGCUAACC | 4989 | GGUUAGCACUCCAUUCAGC | 4990 |
| CUGAAUGGAGUGCUAACCC | 4991 | GGGUUAGCACUCCAUUCAG | 4992 |
| UAACCCUGGUGCUAGAGGA | 4993 | UCCUCUAGCACCAGGGUUA | 4994 |
| AACCCUGGUGCUAGAGGAG | 4995 | CUCCUCUAGCACCAGGGUU | 4996 |
| ACCCUGGUGCUAGAGGAGG | 4997 | CCUCCUCUAGCACCAGGGU | 4998 |
| CCCUGGUGCUAGAGGAGGA | 4999 | UCCUCCUCUAGCACCAGGG | 5000 |
| CCUGGUGCUAGAGGAGGAU | 5001 | AUCCUCCUCUAGCACCAGG | 5002 |
| CUGGUGCUAGAGGAGGAUG | 5003 | CAUCCUCCUCUAGCACCAG | 5004 |
| GGUGCUAGAGGAGGAUGGA | 5005 | UCCAUCCUCCUCUAGCACC | 5006 |
| GUGCUAGAGGAGGAUGGAA | 5007 | UUCCAUCCUCCUCUAGCAC | 5008 |
| CUGCAGUGGACAGUGAGGA | 5009 | UCCUCACUGUCCACUGCAG | 5010 |
| UGCAGUGGACAGUGAGGAC | 5011 | GUCCUCACUGUCCACUGCA | 5012 |
| GCAGUGGACAGUGAGGACU | 5013 | AGUCCUCACUGUCCACUGC | 5014 |
| CAGUGGACAGUGAGGACUU | 5015 | AAGUCCUCACUGUCCACUG | 5016 |
| AGUGGACAGUGAGGACUUC | 5017 | GAAGUCCUCACUGUCCACU | 5018 |
| GUGGACAGUGAGGACUUCU | 5019 | AGAAGUCCUCACUGUCCAC | 5020 |
| UGGACAGUGAGGACUUCUU | 5021 | AAGAAGUCCUCACUGUCCA | 5022 |
| GGACAGUGAGGACUUCUUC | 5023 | GAAGAAGUCCUCACUGUCC | 5024 |
| AGUGAGGACUUCUUCCAGC | 5025 | GCUGGAAGAAGUCCUCACU | 5026 |
| GUGAGGACUUCUUCCAGCU | 5027 | AGCUGGAAGAAGUCCUCAC | 5028 |
| UGAGGACUUCUUCCAGCUG | 5029 | CAGCUGGAAGAAGUCCUCA | 5030 |
| GAGGACUUCUUCCAGCUGC | 5031 | GCAGCUGGAAGAAGUCCUC | 5032 |
| GUGCCUGAUGGUGUUGCAG | 5033 | CUGCAACACCAUCAGGCAC | 5034 |
| GAUGGUGUUGCAGUCUGGU | 5035 | ACCAGACUGCAACACCAUC | 5036 |
| UGGUGUUGCAGUCUGGUCA | 5037 | UGACCAGACUGCAACACCA | 5038 |
| GGUGUUGCAGUCUGGUCAG | 5039 | CUGACCAGACUGCAACACC | 5040 |
| GUGUUGCAGUCUGGUCAGA | 5041 | UCUGACCAGACUGCAACAC | 5042 |
| UGCAGUCUGGUCAGAGCUG | 5043 | CAGCUCUGACCAGACUGCA | 5044 |
| GCAGUCUGGUCAGAGCUGG | 5045 | CCAGCUCUGACCAGACUGC | 5046 |
| CAGUCUGGUCAGAGCUGGA | 5047 | UCCAGCUCUGACCAGACUG | 5048 |
| AGUCUGGUCAGAGCUGGAG | 5049 | CUCCAGCUCUGACCAGACU | 5050 |
| GUCUGGUCAGAGCUGGAGC | 5051 | GCUCCAGCUCUGACCAGAC | 5052 |
| UCUGGUCAGAGCUGGAGCC | 5053 | GGCUCCAGCUCUGACCAGA | 5054 |
| UGGUCAGAGCUGGAGCCCU | 5055 | AGGGCUCCAGCUCUGACCA | 5056 |
| GGUCAGAGCUGGAGCCCUA | 5057 | UAGGGCUCCAGCUCUGACC | 5058 |
| GUCAGAGCUGGAGCCCUAC | 5059 | GUAGGGCUCCAGCUCUGAC | 5060 |
| CAAGGGUAAGAGGCCUAUA | 5061 | UAUAGGCCUCUUACCCUUG | 5062 |
| AAGGGUAAGAGGCCUAUAC | 5063 | GUAUAGGCCUCUUACCCUU | 5064 |
| AGGGUAAGAGGCCUAUACU | 5065 | AGUAUAGGCCUCUUACCCU | 5066 |
| GGGUAAGAGGCCUAUACUG | 5067 | CAGUAUAGGCCUCUUACCC | 5068 |
| GGUAAGAGGCCUAUACUGG | 5069 | CCAGUAUAGGCCUCUUACC | 5070 |
| GUAAGAGGCCUAUACUGGG | 5071 | CCCAGUAUAGGCCUCUUAC | 5072 |
| GGGCUGCUUCCAAUGCCUG | 5073 | CAGGCAUUGGAAGCAGCCC | 5074 |
| GGCUGCUUCCAAUGCCUGU | 5075 | ACAGGCAUUGGAAGCAGCC | 5076 |
| GCUGCUUCCAAUGCCUGUC | 5077 | GACAGGCAUUGGAAGCAGC | 5078 |
| CUGCUUCCAAUGCCUGUCC | 5079 | GGACAGGCAUUGGAAGCAG | 5080 |
| UGCUUCCAAUGCCUGUCCU | 5081 | AGGACAGGCAUUGGAAGCA | 5082 |
| GCUUCCAAUGCCUGUCCUU | 5083 | AAGGACAGGCAUUGGAAGC | 5084 |
| CUUCCAAUGCCUGUCCUUU | 5085 | AAAGGACAGGCAUUGGAAG | 5086 |
| UUCCAAUGCCUGUCCUUUA | 5087 | UAAAGGACAGGCAUUGGAA | 5088 |
| UCCAAUGCCUGUCCUUUAG | 5089 | CUAAAGGACAGGCAUUGGA | 5090 |
| CAAUGCCUGUCCUUUAGAG | 5091 | CUCUAAAGGACAGGCAUUG | 5092 |
| AAUGCCUGUCCUUUAGAGC | 5093 | GCUCUAAAGGACAGGCAUU | 5094 |
| AUGCCUGUCCUUUAGAGCU | 5095 | AGCUCUAAAGGACAGGCAU | 5096 |
| CUUCCUCUCUAGCUUAACC | 5097 | GGUUAAGCUAGAGAGGAAG | 5098 |
| UUCCUCUCUAGCUUAACCC | 5099 | GGGUUAAGCUAGAGAGGAA | 5100 |
| UCUCUAGCUUAACCCUGAU | 5101 | AUCAGGGUUAAGCUAGAGA | 5102 |
| UAGCUUAACCCUGAUCCUG | 5103 | CAGGAUCAGGGUUAAGCUA | 5104 |
| GACCAGGUGCAGGAGGAGU | 5105 | ACUCCUCCUGCACCUGGUC | 5106 |
| ACCAGGUGCAGGAGGAGUU | 5107 | AACUCCUCCUGCACCUGGU | 5108 |
| CCAGGUGCAGGAGGAGUUG | 5109 | CAACUCCUCCUGCACCUGG | 5110 |
| CAGGUGCAGGAGGAGUUGU | 5111 | ACAACUCCUCCUGCACCUG | 5112 |
| AGGUGCAGGAGGAGUUGUG | 5113 | CACAACUCCUCCUGCACCU | 5114 |
| UGCAGGAGGAGUUGUGGAA | 5115 | UUCCACAACUCCUCCUGCA | 5116 |
| GCAGGAGGAGUUGUGGAAU | 5117 | AUUCCACAACUCCUCCUGC | 5118 |
| AGGAGGAGUUGUGGAAUUG | 5119 | CAAUUCCACAACUCCUCCU | 5120 |
| GGAGGAGUUGUGGAAUUGU | 5121 | ACAAUUCCACAACUCCUCC | 5122 |
| GAGGAGUUGUGGAAUUGUC | 5123 | GACAAUUCCACAACUCCUC | 5124 |
| AGGAGUUGUGGAAUUGUCA | 5125 | UGACAAUUCCACAACUCCU | 5126 |
| GGAGUUGUGGAAUUGUCAA | 5127 | UUGACAAUUCCACAACUCC | 5128 |
| GAGUUGUGGAAUUGUCAAG | 5129 | CUUGACAAUUCCACAACUC | 5130 |

TABLE 8-continued

| Sense Sequence | SEQ ID NO: | Antisense Sequence | SEQ ID NO: |
|---|---|---|---|
| AGUUGUGGAAUUGUCAAGG | 5131 | CCUUGACAAUUCCACAACU | 5132 |
| GUUGUGGAAUUGUCAAGGA | 5133 | UCCUUGACAAUUCCACAAC | 5134 |
| UGGAAUUGUCAAGGAUGUC | 5135 | GACAUCCUUGACAAUUCCA | 5136 |
| GGAAUUGUCAAGGAUGUCA | 5137 | UGACAUCCUUGACAAUUCC | 5138 |
| AGUCCAAGCGAGGGAGGGU | 5139 | ACCCUCCCUCGCUUGGACU | 5140 |
| CAAGCGAGGGAGGGUCUGA | 5141 | UCAGACCCUCCCUCGCUUG | 5142 |
| AAGCGAGGGAGGGUCUGAC | 5143 | GUCAGACCCUCCCUCGCUU | 5144 |
| CUGACCCAGUGCUGAUGGA | 5145 | UCCAUCAGCACUGGGUCAG | 5146 |
| AGAUUAGUGGUGGGUGUCU | 5147 | AGACACCCACCACUAAUCU | 5148 |
| AUUAGUGGUGGGUGUCUGG | 5149 | CCAGACACCCACCACUAAU | 5150 |
| UUAGUGGUGGGUGUCUGGU | 5151 | ACCAGACACCCACCACUAA | 5152 |
| UAGUGGUGGGUGUCUGGUA | 5153 | UACCAGACACCCACCACUA | 5154 |
| AGUGGUGGGUGUCUGGUAU | 5155 | AUACCAGACACCCACCACU | 5156 |
| GUGGUGGGUGUCUGGUAUG | 5157 | CAUACCAGACACCCACCAC | 5158 |
| UGGUGGGUGUCUGGUAUGA | 5159 | UCAUACCAGACACCCACCA | 5160 |
| GGUGGGUGUCUGGUAUGAG | 5161 | CUCAUACCAGACACCCACC | 5162 |
| GUGGGUGUCUGGUAUGAGG | 5163 | CCUCAUACCAGACACCCAC | 5164 |
| UGGGUGUCUGGUAUGAGGA | 5165 | UCCUCAUACCAGACACCCA | 5166 |
| GGGUGUCUGGUAUGAGGAU | 5167 | AUCCUCAUACCAGACACCC | 5168 |
| GGUGUCUGGUAUGAGGAUC | 5169 | GAUCCUCAUACCAGACACC | 5170 |
| GUGUCUGGUAUGAGGAUCU | 5171 | AGAUCCUCAUACCAGACAC | 5172 |
| UGUCUGGUAUGAGGAUCUA | 5173 | UAGAUCCUCAUACCAGACA | 5174 |
| CAAGGGUGUCCUACAGAGU | 5175 | ACUCUGUAGGACACCCUUG | 5176 |
| AAGGGUGUCCUACAGAGUG | 5177 | CACUCUGUAGGACACCCUU | 5178 |
| AGGGUGUCCUACAGAGUGG | 5179 | CCACUCUGUAGGACACCCU | 5180 |
| GGGUGUCCUACAGAGUGGA | 5181 | UCCACUCUGUAGGACACCC | 5182 |
| GGUGUCCUACAGAGUGGAG | 5183 | CUCCACUCUGUAGGACACC | 5184 |
| UCCUACAGAGUGGAGUGCU | 5185 | AGCACUCCACUCUGUAGGA | 5186 |
| AGUGGAGUGCUGUCAUAUG | 5187 | CAUAUGACAGCACUCCACU | 5188 |
| GUGGAGUGCUGUCAUAUGG | 5189 | CCAUAUGACAGCACUCCAC | 5190 |
| UGGAGUGCUGUCAUAUGGC | 5191 | GCCAUAUGACAGCACUCCA | 5192 |
| GGAGUGCUGUCAUAUGGCC | 5193 | GGCCAUAUGACAGCACUCC | 5194 |
| GAGUGCUGUCAUAUGGCCU | 5195 | AGGCCAUAUGACAGCACUC | 5196 |
| AGUGCUGUCAUAUGGCCUG | 5197 | CAGGCCAUAUGACAGCACU | 5198 |
| GUGCUGUCAUAUGGCCUGG | 5199 | CCAGGCCAUAUGACAGCAC | 5200 |
| UGCUGUCAUAUGGCCUGGG | 5201 | CCCAGGCCAUAUGACAGCA | 5202 |
| GCUGUCAUAUGGCCUGGGA | 5203 | UCCCAGGCCAUAUGACAGC | 5204 |
| CUGUCAUAUGGCCUGGGAC | 5205 | GUCCCAGGCCAUAUGACAG | 5206 |
| UGUCAUAUGGCCUGGGACG | 5207 | CGUCCCAGGCCAUAUGACA | 5208 |
| GUCAUAUGGCCUGGGACGG | 5209 | CCGUCCCAGGCCAUAUGAC | 5210 |
| AGAGGCCCAAGCACAGCAA | 5211 | UUGCUGUGCUUGGGCCUCU | 5212 |
| GAGGCCCAAGCACAGCAAG | 5213 | CUUGCUGUGCUUGGGCCUC | 5214 |
| AGGCCCAAGCACAGCAAGG | 5215 | CCUUGCUGUGCUUGGGCCU | 5216 |
| GGCCCAAGCACAGCAAGGA | 5217 | UCCUUGCUGUGCUUGGGCC | 5218 |
| CCAAGCACAGCAAGGACAU | 5219 | AUGUCCUUGCUGUGCUUGG | 5220 |
| GCCCGAUUCACCUUUGACG | 5221 | CGUCAAAGGUGAAUCGGGC | 5222 |
| GAUUCACCUUUGACGUGUA | 5223 | UACACGUCAAAGGUGAAUC | 5224 |
| AUUCACCUUUGACGUGUAC | 5225 | GUACACGUCAAAGGUGAAU | 5226 |
| UUGGCAGCCUGAAUGUCAA | 5227 | UUGACAUUCAGGCUGCCAA | 5228 |
| UGGCAGCCUGAAUGUCAAA | 5229 | UUUGACAUUCAGGCUGCCA | 5230 |
| GGCAGCCUGAAUGUCAAAG | 5231 | CUUUGACAUUCAGGCUGCC | 5232 |
| GCAGCCUGAAUGUCAAAGC | 5233 | GCUUUGACAUUCAGGCUGC | 5234 |
| CAGCCUGAAUGUCAAAGCC | 5235 | GGCUUUGACAUUCAGGCUG | 5236 |
| AGCCUGAAUGUCAAAGCCA | 5237 | UGGCUUUGACAUUCAGGCU | 5238 |
| GCCUGAAUGUCAAAGCCAC | 5239 | GUGGCUUUGACAUUCAGGC | 5240 |
| GUCAAAGCCACAUUCUACG | 5241 | CGUAGAAUGUGGCUUUGAC | 5242 |
| UCAAAGCCACAUUCUACGG | 5243 | CCGUAGAAUGUGGCUUUGA | 5244 |
| CAAAGCCACAUUCUACGGG | 5245 | CCCGUAGAAUGUGGCUUUG | 5246 |
| AAAGCCACAUUCUACGGGC | 5247 | GCCCGUAGAAUGUGGCUUU | 5248 |
| GCCACAUUCUACGGGCUCU | 5249 | AGAGCCCGUAGAAUGUGGC | 5250 |
| CCACAUUCUACGGGCUCUA | 5251 | UAGAGCCCGUAGAAUGUGG | 5252 |
| CACAUUCUACGGGCUCUAC | 5253 | GUAGAGCCCGUAGAAUGUG | 5254 |
| UUCUACGGGCUCUACUCUA | 5255 | UAGAGUAGAGCCCGUAGAA | 5256 |
| UCUACGGGCUCUACUCUAU | 5257 | AUAGAGUAGAGCCCGUAGA | 5258 |
| CUACGGGCUCUACUCUAUG | 5259 | CAUAGAGUAGAGCCCGUAG | 5260 |
| CUCUAUGAGUUGUGACUUU | 5261 | AAAGUCACAACUCAUAGAG | 5262 |
| UCUAUGAGUUGUGACUUUC | 5263 | GAAAGUCACAACUCAUAGA | 5264 |
| UGAGUUGUGACUUUCAAGG | 5265 | CCUUGAAAGUCACAACUCA | 5266 |
| GAGUUGUGACUUUCAAGGA | 5267 | UCCUUGAAAGUCACAACUC | 5268 |
| AGUUGUGACUUUCAAGGAC | 5269 | GUCCUUGAAAGUCACAACU | 5270 |
| GUUGUGACUUUCAAGGACU | 5271 | AGUCCUUGAAAGUCACAAC | 5272 |
| GACUUUCAAGGACUUGGCC | 5273 | GGCCAAGUCCUUGAAAGUC | 5274 |
| UUUCAAGGACUUGGCCAA | 5275 | UUGGGCCAAGUCCUUGAAA | 5276 |
| UUCAAGGACUUGGCCCAAA | 5277 | UUUGGGCCAAGUCCUUGAA | 5278 |
| CCCUACAGUUGGAUAGUCC | 5279 | GGACUAUCCAACUGUAGGG | 5280 |
| CCUACAGUUGGAUAGUCCC | 5281 | GGGACUAUCCAACUGUAGG | 5282 |

TABLE 8-continued

| Sense Sequence | SEQ ID NO: | Antisense Sequence | SEQ ID NO: |
|---|---|---|---|
| AUUCGUCCUCUUGCACCCA | 5283 | UGGGUGCAAGAGGACGAAU | 5284 |
| UUCGUCCUCUUGCACCCAC | 5285 | GUGGGUGCAAGAGGACGAA | 5286 |
| UCCUCUUGCACCCACCUAC | 5287 | GUAGGUGGGUGCAAGAGGA | 5288 |
| CCUCUUGCACCCACCUACC | 5289 | GGUAGGUGGGUGCAAGAGG | 5290 |
| CUCUUGCACCCACCUACCC | 5291 | GGGUAGGUGGGUGCAAGAG | 5292 |
| CUAGUUAGCUCUUGCUUGU | 5293 | ACAAGCAAGAGCUAACUAG | 5294 |
| UAGUUAGCUCUUGCUUGUG | 5295 | CACAAGCAAGAGCUAACUA | 5296 |
| AGUUAGCUCUUGCUUGUGG | 5297 | CCACAAGCAAGAGCUAACU | 5298 |
| UUAGCUCUUGCUUGUGGAA | 5299 | UUCCACAAGCAAGAGCUAA | 5300 |
| UCCUCAUCUCCCAGCUUGA | 5301 | UCAAGCUGGGAGAUGAGGA | 5302 |
| AUCUCCCAGCUUGAUGGCU | 5303 | AGCCAUCAAGCUGGGAGAU | 5304 |
| UCUCCCAGCUUGAUGGCUU | 5305 | AAGCCAUCAAGCUGGGAGA | 5306 |
| CUCCCAGCUUGAUGGCUUC | 5307 | GAAGCCAUCAAGCUGGGAG | 5308 |
| UCCCAGCUUGAUGGCUUCC | 5309 | GGAAGCCAUCAAGCUGGGA | 5310 |
| CCCAGCUUGAUGGCUUCCU | 5311 | AGGAAGCCAUCAAGCUGGG | 5312 |
| CCAGCUUGAUGGCUUCCUC | 5313 | GAGGAAGCCAUCAAGCUGG | 5314 |
| UGAUGGCUUCCUCCCAAGU | 5315 | ACUUGGGAGGAAGCCAUCA | 5316 |
| GAUGGCUUCCUCCCAAGUU | 5317 | AACUUGGGAGGAAGCCAUC | 5318 |
| GGCUUCCUCCCAAGUUUUC | 5319 | GAAAACUUGGGAGGAAGCC | 5320 |
| CCUCCCAAGUUUUCCAAAU | 5321 | AUUUGGAAAACUUGGGAGG | 5322 |
| CCCAAGUUUUCCAAAUCAU | 5323 | AUGAUUUGGAAAACUUGGG | 5324 |
| CCAAGUUUUCCAAAUCAUC | 5325 | GAUGAUUUGGAAAACUUGG | 5326 |
| CAAGUUUUCCAAAUCAUCU | 5327 | AGAUGAUUUGGAAAACUUG | 5328 |
| AAGUUUUCCAAAUCAUCUG | 5329 | CAGAUGAUUUGGAAAACUU | 5330 |
| GUUUUCCAAAUCAUCUGAU | 5331 | AUCAGAUGAUUUGGAAAAC | 5332 |
| AUCUGAUUCCUCUUGUCU | 5333 | AGACAAGAGGAAAUCAGAU | 5334 |
| UCUGAUUUCCUCUUGUCUC | 5335 | GAGACAAGAGGAAAUCAGA | 5336 |
| CUGAUUUCCUCUUGUCUCU | 5337 | AGAGACAAGAGGAAAUCAG | 5338 |
| CUCUUGUCUCUGCCAUUCA | 5339 | UGAAUGGCAGAGACAAGAG | 5340 |
| GUUGGACCUCCACACUGCU | 5341 | AGCAGUGUGGAGGUCCAAC | 5342 |
| CCACACUGCUGCAAGGCCU | 5343 | AGGCCUUGCAGCAGUGUGG | 5344 |
| CACACUGCUGCAAGGCCUG | 5345 | CAGGCCUUGCAGCAGUGUG | 5346 |
| ACACUGCUGCAAGGCCUGG | 5347 | CCAGGCCUUGCAGCAGUGU | 5348 |
| UGCAAGGCCUGGGCCAUAU | 5349 | AUAUGGCCCAGGCCUUGCA | 5350 |
| GCAAGGCCUGGGCCAUAUG | 5351 | CAUAUGGCCCAGGCCUUGC | 5352 |
| CAAGGCCUGGGCCAUAUGU | 5353 | ACAUAUGGCCCAGGCCUUG | 5354 |
| AAGGCCUGGGCCAUAUGUU | 5355 | AACAUAUGGCCCAGGCCUU | 5356 |
| AGGCCUGGGCCAUAUGUUG | 5357 | CAACAUAUGGCCCAGGCCU | 5358 |
| GGCCUGGGCCAUAUGUUGC | 5359 | GCAACAUAUGGCCCAGGCC | 5360 |
| GCCUGGGCCAUAUGUUGCU | 5361 | AGCAACAUAUGGCCCAGGC | 5362 |
| CCUGGGCCAUAUGUUGCUG | 5363 | CAGCAACAUAUGGCCCAGG | 5364 |
| GGCCAUAUGUUGCUGGGAA | 5365 | UUCCCAGCAACAUAUGGCC | 5366 |
| CCAUAUGUUGCUGGGAAUU | 5367 | AAUUCCCAGCAACAUAUGG | 5368 |
| GGAAUUUCCUCCACCCUUC | 5369 | GAAGGGUGGAGGAAAUUCC | 5370 |
| GAAUUUCCUCCACCCUUCG | 5371 | CGAAGGGUGGAGGAAAUUC | 5372 |
| AAUUUCCUCCACCCUUCGU | 5373 | ACGAAGGGUGGAGGAAAUU | 5374 |
| AUUUCCUCCACCCUUCGUC | 5375 | GACGAAGGGUGGAGGAAAU | 5376 |
| UUUCCUCCACCCUUCGUCA | 5377 | UGACGAAGGGUGGAGGAAA | 5378 |
| UUCCUCCACCCUUCGUCAU | 5379 | AUGACGAAGGGUGGAGGAA | 5380 |
| UCCUCCACCCUUCGUCAUG | 5381 | CAUGACGAAGGGUGGAGGA | 5382 |
| CCUCCACCCUUCGUCAUGC | 5383 | GCAUGACGAAGGGUGGAGG | 5384 |
| CUCCACCCUUCGUCAUGCA | 5385 | UGCAUGACGAAGGGUGGAG | 5386 |
| CCUUCGUCAUGCAGUGGAG | 5387 | CUCCACUGCAUGACGAAGG | 5388 |
| CUUCGUCAUGCAGUGGAGG | 5389 | CCUCCACUGCAUGACGAAG | 5390 |
| UUCGUCAUGCAGUGGAGGG | 5391 | CCCUCCACUGCAUGACGAA | 5392 |
| CGCCUCCAUUCCUACUAAG | 5393 | CUUAGUAGGAAUGGAGGCG | 5394 |
| GCCUCCAUUCCUACUAAGG | 5395 | CCUUAGUAGGAAUGGAGGC | 5396 |
| CCUCCAUUCCUACUAAGGG | 5397 | CCCUUAGUAGGAAUGGAGG | 5398 |
| CAGAAUCAUUCCAACCGAC | 5399 | GUCGGUUGGAAUGAUUCUG | 5400 |
| AGAAUCAUUCCAACCGACC | 5401 | GGUCGGUUGGAAUGAUUCU | 5402 |
| GAAUCAUUCCAACCGACCC | 5403 | GGGUCGGUUGGAAUGAUUC | 5404 |
| AAUCAUUCCAACCGACCCA | 5405 | UGGGUCGGUUGGAAUGAUU | 5406 |
| AUCAUUCCAACCGACCCAC | 5407 | GUGGGUCGGUUGGAAUGAU | 5408 |
| UCAUUCCAACCGACCCACU | 5409 | AGUGGGUCGGUUGGAAUGA | 5410 |
| UCCAACCGACCCACUGCAA | 5411 | UUGCAGUGGGUCGGUUGGA | 5412 |
| CCAACCGACCCACUGCAAA | 5413 | UUUGCAGUGGGUCGGUUGG | 5414 |
| CAACCGACCCACUGCAAAG | 5415 | CUUUGCAGUGGGUCGGUUG | 5416 |
| AACCGACCCACUGCAAAGA | 5417 | UCUUUGCAGUGGGUCGGUU | 5418 |
| ACCGACCCACUGCAAAGAC | 5419 | GUCUUUGCAGUGGGUCGGU | 5420 |
| CCGACCCACUGCAAAGACU | 5421 | AGUCUUUGCAGUGGGUCGG | 5422 |
| CGACCCACUGCAAAGACUA | 5423 | UAGUCUUUGCAGUGGGUCG | 5424 |
| GACCCACUGCAAAGACUAU | 5425 | AUAGUCUUUGCAGUGGGUC | 5426 |
| ACCCACUGCAAAGACUAUG | 5427 | CAUAGUCUUUGCAGUGGGU | 5428 |
| ACUGCAAAGACUAUGACAG | 5429 | CUGUCAUAGUCUUUGCAGU | 5430 |
| CUGCAAAGACUAUGACAGC | 5431 | GCUGUCAUAGUCUUUGCAG | 5432 |
| UGCAAAGACUAUGACAGCA | 5433 | UGCUGUCAUAGUCUUUGCA | 5434 |

TABLE 8-continued

| Sense Sequence | SEQ ID NO: | Antisense Sequence | SEQ ID NO: |
|---|---|---|---|
| GCAAAGACUAUGACAGCAU | 5435 | AUGCUGUCAUAGUCUUUGC | 5436 |
| AAAGACUAUGACAGCAUCA | 5437 | UGAUGCUGUCAUAGUCUUU | 5438 |
| AAGACUAUGACAGCAUCAA | 5439 | UUGAUGCUGUCAUAGUCUU | 5440 |
| AGACUAUGACAGCAUCAAA | 5441 | UUUGAUGCUGUCAUAGUCU | 5442 |
| GACUAUGACAGCAUCAAAU | 5443 | AUUUGAUGCUGUCAUAGUC | 5444 |
| CUAUGACAGCAUCAAAUUU | 5445 | AAAUUUGAUGCUGUCAUAG | 5446 |
| UAUGACAGCAUCAAAUUUC | 5447 | GAAAUUUGAUGCUGUCAUA | 5448 |
| GCAUCAAAUUUCAGGACCU | 5449 | AGGUCCUGAAAUUUGAUGC | 5450 |
| AUCAAAUUUCAGGACCUGC | 5451 | GCAGGUCCUGAAAUUUGAU | 5452 |
| UCAAAUUUCAGGACCUGCA | 5453 | UGCAGGUCCUGAAAUUUGA | 5454 |
| UUCAGGACCUGCAGACAGU | 5455 | ACUGUCUGCAGGUCCUGAA | 5456 |
| UCAGGACCUGCAGACAGUA | 5457 | UACUGUCUGCAGGUCCUGA | 5458 |
| CAGGACCUGCAGACAGUAC | 5459 | GUACUGUCUGCAGGUCCUG | 5460 |
| AGGACCUGCAGACAGUACA | 5461 | UGUACUGUCUGCAGGUCCU | 5462 |
| GGACCUGCAGACAGUACAG | 5463 | CUGUACUGUCUGCAGGUCC | 5464 |
| CUGCAGACAGUACAGGCUA | 5465 | UAGCCUGUACUGUCUGCAG | 5466 |
| GACAGUACAGGCUAGAUAA | 5467 | UUAUCUAGCCUGUACUGUC | 5468 |
| ACAGUACAGGCUAGAUAAC | 5469 | GUUAUCUAGCCUGUACUGU | 5470 |
| CAGUACAGGCUAGAUAACC | 5471 | GGUUAUCUAGCCUGUACUG | 5472 |
| AGUACAGGCUAGAUAACCC | 5473 | GGGUUAUCUAGCCUGUACU | 5474 |
| GUACAGGCUAGAUAACCCA | 5475 | UGGGUUAUCUAGCCUGUAC | 5476 |
| UACAGGCUAGAUAACCCAC | 5477 | GUGGGUUAUCUAGCCUGUA | 5478 |
| GCUAGAUAACCCACCCAAU | 5479 | AUUGGGUGGGUUAUCUAGC | 5480 |
| CUAGAUAACCCACCCAAUU | 5481 | AAUUGGGUGGGUUAUCUAG | 5482 |
| AGAUAACCCACCCAAUUUC | 5483 | GAAAUUGGGUGGGUUAUCU | 5484 |
| GAUAACCCACCCAAUUUCC | 5485 | GGAAAUUGGGUGGGUUAUC | 5486 |
| AACCUUUCAGCAUAACGCC | 5487 | GGCGUUAUGCUGAAAGGUU | 5488 |
| ACCUUUCAGCAUAACGCCU | 5489 | AGGCGUUAUGCUGAAAGGU | 5490 |
| CCUUUCAGCAUAACGCCUC | 5491 | GAGGCGUUAUGCUGAAAGG | 5492 |
| CUUUCAGCAUAACGCCUCA | 5493 | UGAGGCGUUAUGCUGAAAG | 5494 |
| UUUCAGCAUAACGCCUCAC | 5495 | GUGAGGCGUUAUGCUGAAA | 5496 |
| UUCAGCAUAACGCCUCACA | 5497 | UGUGAGGCGUUAUGCUGAA | 5498 |
| UCAGCAUAACGCCUCACAU | 5499 | AUGUGAGGCGUUAUGCUGA | 5500 |
| CAGCAUAACGCCUCACAUC | 5501 | GAUGUGAGGCGUUAUGCUG | 5502 |
| AGCAUAACGCCUCACAUCC | 5503 | GGAUGUGAGGCGUUAUGCU | 5504 |
| GCAUAACGCCUCACAUCCC | 5505 | GGGAUGUGAGGCGUUAUGC | 5506 |
| AACGCCUCACAUCCCAAGU | 5507 | ACUUGGGAUGUGAGGCGUU | 5508 |
| ACGCCUCACAUCCCAAGUC | 5509 | GACUUGGGAUGUGAGGCGU | 5510 |
| CGCCUCACAUCCCAAGUCU | 5511 | AGACUUGGGAUGUGAGGCG | 5512 |
| UCACAUCCCAAGUCUAUAC | 5513 | GUAUAGACUUGGGAUGUGA | 5514 |
| CACAUCCCAAGUCUAUACC | 5515 | GGUAUAGACUUGGGAUGUG | 5516 |
| ACAUCCCAAGUCUAUACCC | 5517 | GGGUAUAGACUUGGGAUGU | 5518 |
| CAUCCCAAGUCUAUACCCU | 5519 | AGGGUAUAGACUUGGGAUG | 5520 |
| AAUGCUGUUCUUUCCUAGC | 5521 | GCUAGGAAAGAACAGCAUU | 5522 |
| AUGCUGUUCUUUCCUAGCC | 5523 | GGCUAGGAAAGAACAGCAU | 5524 |
| CUGUUCUUUCCUAGCCACC | 5525 | GGUGGCUAGGAAAGAACAG | 5526 |
| UGUUCUUUCCUAGCCACCU | 5527 | AGGUGGCUAGGAAAGAACA | 5528 |
| GCCAAGAUCAAGAUGUCCC | 5529 | GGGACAUCUUGAUCUUGGC | 5530 |
| UCUUGAUCCCAGCCUGACU | 5531 | AGUCAGGCUGGGAUCAAGA | 5532 |
| CUUGAUCCCAGCCUGACUG | 5533 | CAGUCAGGCUGGGAUCAAG | 5534 |
| UUGAUCCCAGCCUGACUGC | 5535 | GCAGUCAGGCUGGGAUCAA | 5536 |
| UGAUCCCAGCCUGACUGCU | 5537 | AGCAGUCAGGCUGGGAUCA | 5538 |
| CUGACUGCUGCUACAUCUA | 5539 | UAGAUGUAGCAGCAGUCAG | 5540 |
| GACUGCUGCUACAUCUAAU | 5541 | AUUAGAUGUAGCAGCAGUC | 5542 |
| ACUGCUGCUACAUCUAAUC | 5543 | GAUUAGAUGUAGCAGCAGU | 5544 |
| CUGCUGCUACAUCUAAUCC | 5545 | GGAUUAGAUGUAGCAGCAG | 5546 |
| UGCUGCUACAUCUAAUCCC | 5547 | GGGAUUAGAUGUAGCAGCA | 5548 |
| CCUACCAAUGCCUCCUGUC | 5549 | GACAGGAGGCAUUGGUAGG | 5550 |
| CUACCAAUGCCUCCUGUCC | 5551 | GGACAGGAGGCAUUGGUAG | 5552 |
| CCAAUGCCUCCUGUCCCUA | 5553 | UAGGGACAGGAGGCAUUGG | 5554 |
| CAAUGCCUCCUGUCCCUAA | 5555 | UUAGGGACAGGAGGCAUUG | 5556 |
| AAUGCCUCCUGUCCCUAAA | 5557 | UUUAGGGACAGGAGGCAUU | 5558 |
| CCCAGCAUACUGAUGACAG | 5559 | CUGUCAUCAGUAUGCUGGG | 5560 |
| CCAGCAUACUGAUGACAGC | 5561 | GCUGUCAUCAGUAUGCUGG | 5562 |
| CAUACUGAUGACAGCCCUC | 5563 | GAGGGCUGUCAUCAGUAUG | 5564 |
| AUACUGAUGACAGCCCUCU | 5565 | AGAGGGCUGUCAUCAGUAU | 5566 |
| UACUGAUGACAGCCCUCUC | 5567 | GAGAGGGCUGUCAUCAGUA | 5568 |
| ACUGAUGACAGCCCUCUCU | 5569 | AGAGAGGGCUGUCAUCAGU | 5570 |
| CUGAUGACAGCCCUCUCUG | 5571 | CAGAGAGGGCUGUCAUCAG | 5572 |
| UGAUGACAGCCCUCUCUGA | 5573 | UCAGAGAGGGCUGUCAUCA | 5574 |
| GAUGACAGCCCUCUCUGAC | 5575 | GUCAGAGAGGGCUGUCAUC | 5576 |
| AUGACAGCCCUCUCUGACU | 5577 | AGUCAGAGAGGGCUGUCAU | 5578 |
| UGACAGCCCUCUCUGACUU | 5579 | AAGUCAGAGAGGGCUGUCA | 5580 |
| GACAGCCCUCUCUGACUUU | 5581 | AAAGUCAGAGAGGGCUGUC | 5582 |
| ACAGCCCUCUCUGACUUUA | 5583 | UAAAGUCAGAGAGGGCUGU | 5584 |
| CAGCCCUCUCUGACUUUAC | 5585 | GUAAAGUCAGAGAGGGCUG | 5586 |

TABLE 8-continued

| Sense Sequence | SEQ ID NO: | Antisense Sequence | SEQ ID NO: |
|---|---|---|---|
| AGCCCUCUCUGACUUUACC | 5587 | GGUAAAGUCAGAGAGGGCU | 5588 |
| GCCCUCUCUGACUUUACCU | 5589 | AGGUAAAGUCAGAGAGGGC | 5590 |
| CCCUCUCUGACUUUACCUU | 5591 | AAGGUAAAGUCAGAGAGGG | 5592 |
| CCUCUCUGACUUUACCUUG | 5593 | CAAGGUAAAGUCAGAGAGG | 5594 |
| CUCUCUGACUUUACCUUGA | 5595 | UCAAGGUAAAGUCAGAGAG | 5596 |
| AGAUCUGUCUUCAUACCCU | 5597 | AGGGUAUGAAGACAGAUCU | 5598 |
| GAUCUGUCUUCAUACCCUU | 5599 | AAGGGUAUGAAGACAGAUC | 5600 |
| CUGUCUUCAUACCCUUCCC | 5601 | GGGAAGGGUAUGAAGACAG | 5602 |

In some embodiments, the siRNA molecules targeted to Transcript B comprise or consist of the nucleotide sequences (sense and antisense strands) shown in Table 9.

TABLE 9

| Sense Sequence | SEQ ID NO: | Antisense Sequence | SEQ ID NO: |
|---|---|---|---|
| CCAGAGCAAGCCGAAGGCA | 5603 | UGCCUUCGGCUUGCUCUGG | 5604 |
| CAGAGCAAGCCGAAGGCAA | 5605 | UUGCCUUCGGCUUGCUCUG | 5606 |
| AGAGCAAGCCGAAGGCAAG | 5607 | CUUGCCUUCGGCUUGCUCU | 5608 |
| GAGCAAGCCGAAGGCAAGC | 5609 | GCUUGCCUUCGGCUUGCUC | 5610 |
| AGCAAGCCGAAGGCAAGCA | 5611 | UGCUUGCCUUCGGCUUGCU | 5612 |
| GCAAGCCGAAGGCAAGCAC | 5613 | GUGCUUGCCUUCGGCUUGC | 5614 |
| CAAGCCGAAGGCAAGCACG | 5615 | CGUGCUUGCCUUCGGCUUG | 5616 |
| AAGCCGAAGGCAAGCACGA | 5617 | UCGUGCUUGCCUUCGGCUU | 5618 |
| AGCCGAAGGCAAGCACGAU | 5619 | AUCGUGCUUGCCUUCGGCU | 5620 |
| GCCGAAGGCAAGCACGAUG | 5621 | CAUCGUGCUUGCCUUCGGC | 5622 |
| AAGGCAAGCACGAUGGCGC | 5623 | GCGCCAUCGUGCUUGCCUU | 5624 |
| AGGCAAGCACGAUGGCGCU | 5625 | AGCGCCAUCGUGCUUGCCU | 5626 |
| AAGCACGAUGGCGCUCACC | 5627 | GGUGAGCGCCAUCGUGCUU | 5628 |
| AGCACGAUGGCGCUCACCA | 5629 | UGGUGAGCGCCAUCGUGCU | 5630 |
| CUGUAGCAGCCGAGCAUCA | 5631 | UGAUGCUCGGCUGCUACAG | 5632 |
| AGCCGAGCAUCAGCCCGAA | 5633 | UUCGGGCUGAUGCUCGGCU | 5634 |
| GUCAGAGUCUCCAGGCUCA | 5635 | UGAGCCUGGAGACUCUGAC | 5636 |
| UCAGAGUCUCCAGGCUCAG | 5637 | CUGAGCCUGGAGACUCUGA | 5638 |
| CAGAGUCUCCAGGCUCAGG | 5639 | CCUGAGCCUGGAGACUCUG | 5640 |
| AGAGUCUCCAGGCUCAGGU | 5641 | ACCUGAGCCUGGAGACUCU | 5642 |
| GAGUCUCCAGGCUCAGGUG | 5643 | CACCUGAGCCUGGAGACUC | 5644 |
| AGUCUCCAGGCUCAGGUGG | 5645 | CCACCUGAGCCUGGAGACU | 5646 |
| GGGUGGCACAGCUGGCAUA | 5647 | UAUGCCAGCUGUGCCACCC | 5648 |
| GUGGCACAGCUGGCAUACG | 5649 | CGUAUGCCAGCUGUGCCAC | 5650 |

TABLE 9-continued

| Sense Sequence | SEQ ID NO: | Antisense Sequence | SEQ ID NO: |
|---|---|---|---|
| UGGCACAGCUGGCAUACGC | 5651 | GCGUAUGCCAGCUGUGCCA | 5652 |
| CUCCACAGGUGGCGGUAGA | 5653 | UCUACCGCCACCUGUGGAG | 5654 |
| UCCACAGGUGGCGGUAGAC | 5655 | GUCUACCGCCACCUGUGGA | 5656 |
| UGAGCAGCACGCUGGCGUA | 5657 | UACGCCAGCGUGCUGCUCA | 5658 |
| AGCAGCACGCUGGCGUACA | 5659 | UGUACGCCAGCGUGCUGCU | 5660 |
| GCAGCACGCUGGCGUACAU | 5661 | AUGUACGCCAGCGUGCUGC | 5662 |
| CAGCACGCUGGCGUACAUG | 5663 | CAUGUACGCCAGCGUGCUG | 5664 |
| AGCACGCUGGCGUACAUGC | 5665 | GCAUGUACGCCAGCGUGCU | 5666 |
| GCACGCUGGCGUACAUGCU | 5667 | AGCAUGUACGCCAGCGUGC | 5668 |
| CACGCUGGCGUACAUGCUG | 5669 | CAGCAUGUACGCCAGCGUG | 5670 |
| ACGCUGGCGUACAUGCUGA | 5671 | UCAGCAUGUACGCCAGCGU | 5672 |
| CUGGCGUACAUGCUGAGCG | 5673 | CGCUCAGCAUGUACGCCAG | 5674 |
| UGGCGUACAUGCUGAGCGC | 5675 | GCGCUCAGCAUGUACGCCA | 5676 |
| CGCGCACACGUAGUACACC | 5677 | GGUGUACUACGUGUGCGCG | 5678 |
| GCGCACACGUAGUACACCG | 5679 | CGGUGUACUACGUGUGCGC | 5680 |
| CGCACACGUAGUACACCGC | 5681 | GCGGUGUACUACGUGUGCG | 5682 |
| GCACACGUAGUACACCGCC | 5683 | GGCGGUGUACUACGUGUGC | 5684 |
| CACACGUAGUACACCGCCU | 5685 | AGGCGGUGUACUACGUGUG | 5686 |
| ACACGUAGUACACCGCCUU | 5687 | AAGGCGGUGUACUACGUGU | 5688 |
| CACGUAGUACACCGCCUUG | 5689 | CAAGGCGGUGUACUACGUG | 5690 |
| UAGUACACCGCCUUGCAGC | 5691 | GCUGCAAGGCGGUGUACUA | 5692 |
| CCAAGCUCCACACCACGAA | 5693 | UUCGUGGUGUGGAGCUUGG | 5694 |
| CAAGCUCCACACCACGAAG | 5695 | CUUCGUGGUGUGGAGCUUG | 5696 |
| AAGCUCCACACCACGAAGC | 5697 | GCUUCGUGGUGUGGAGCUU | 5698 |
| AGCUCCACACCACGAAGCC | 5699 | GGCUUCGUGGUGUGGAGCU | 5700 |
| CUCCACACCACGAAGCCGU | 5701 | ACGGCUUCGUGGUGUGGAG | 5702 |
| UCCACACCACGAAGCCGUU | 5703 | AACGGCUUCGUGGUGUGGA | 5704 |
| CCACACCACGAAGCCGUUG | 5705 | CAACGGCUUCGUGGUGUGG | 5706 |
| CACACCACGAAGCCGUUGC | 5707 | GCAACGGCUUCGUGGUGUG | 5708 |
| ACACCACGAAGCCGUUGCC | 5709 | GGCAACGGCUUCGUGGUGU | 5710 |
| CACCACGAAGCCGUUGCCA | 5711 | UGGCAACGGCUUCGUGGUG | 5712 |
| ACCACGAAGCCGUUGCCAG | 5713 | CUGGCAACGGCUUCGUGGU | 5714 |
| CCGCGAAGUCUUCCAGCUC | 5715 | GAGCUGGAAGACUUCGCGG | 5716 |
| CGCGAAGUCUUCCAGCUCA | 5717 | UGAGCUGGAAGACUUCGCG | 5718 |
| GCGAAGUCUUCCAGCUCAG | 5719 | CUGAGCUGGAAGACUUCGC | 5720 |
| UUCCAGCUCAGCAGUGUCU | 5721 | AGACACUGCUGAGCUGGAA | 5722 |
| UCCAGCUCAGCAGUGUCUC | 5723 | GAGACACUGCUGAGCUGGA | 5724 |
| CCAGCUCAGCAGUGUCUCG | 5725 | CGAGACACUGCUGAGCUGG | 5726 |

TABLE 9-continued

| Sense Sequence | SEQ ID NO: | Antisense Sequence | SEQ ID NO: |
|---|---|---|---|
| CAGCUCAGCAGUGUCUCGU | 5727 | ACGAGACACUGCUGAGCUG | 5728 |
| AGCUCAGCAGUGUCUCGUU | 5729 | AACGAGACACUGCUGAGCU | 5730 |
| GCUCAGCAGUGUCUCGUUC | 5731 | GAACGAGACACUGCUGAGC | 5732 |
| CUCAGCAGUGUCUCGUUCC | 5733 | GGAACGAGACACUGCUGAG | 5734 |
| GUAGCAGACCGACAUCCUU | 5735 | AAGGAUGUCGGUCUGCUAC | 5736 |
| UAGCAGACCGACAUCCUUC | 5737 | GAAGGAUGUCGGUCUGCUA | 5738 |
| AGCAGACCGACAUCCUUCU | 5739 | AGAAGGAUGUCGGUCUGCU | 5740 |
| AGACCGACAUCCUUCUGGG | 5741 | CCCAGAAGGAUGUCGGUCU | 5742 |
| GACCGACAUCCUUCUGGGC | 5743 | GCCCAGAAGGAUGUCGGUC | 5744 |
| CCGACAUCCUUCUGGGCCU | 5745 | AGGCCCAGAAGGAUGUCGG | 5746 |
| CGACAUCCUUCUGGGCCUA | 5747 | UAGGCCCAGAAGGAUGUCG | 5748 |
| GACAUCCUUCUGGGCCUAC | 5749 | GUAGGCCCAGAAGGAUGUC | 5750 |
| CUUCUGGGCCUACAGGUGG | 5751 | CCACCUGUAGGCCCAGAAG | 5752 |
| UUCUGGGCCUACAGGUGGG | 5753 | CCCACCUGUAGGCCCAGAA | 5754 |
| UCUGGGCCUACAGGUGGGU | 5755 | ACCCACCUGUAGGCCCAGA | 5756 |
| GGCCUACAGGUGGGUGGAA | 5757 | UUCCACCCACCUGUAGGCC | 5758 |
| CCUACAGGUGGGUGGAAGG | 5759 | CCUUCCACCCACCUGUAGG | 5760 |
| CUACAGGUGGGUGGAAGGC | 5761 | GCCUUCCACCCACCUGUAG | 5762 |
| UACAGGUGGGUGGAAGGCG | 5763 | CGCCUUCCACCCACCUGUA | 5764 |
| ACUUCCUGCAGCCUGCCU | 5765 | AGGCAGGCUGCAGGGAAGU | 5766 |
| CCUGCAGCCUGCCUCUUUU | 5767 | AAAAGAGGCAGGCUGCAGG | 5768 |
| CUGCAGCCUGCCUCUUUUC | 5769 | GAAAAGAGGCAGGCUGCAG | 5770 |
| GCAGCCUGCCUCUUUUCUG | 5771 | CAGAAAAGAGGCAGGCUGC | 5772 |
| CAGCCUGCCUCUUUUCUGC | 5773 | GCAGAAAAGAGGCAGGCUG | 5774 |
| AGCCUGCCUCUUUUCUGCC | 5775 | GGCAGAAAAGAGGCAGGCU | 5776 |
| GCCUCUUUUCUGCCUGGGA | 5777 | UCCCAGGCAGAAAAGAGGC | 5778 |
| CUUUUCUGCCUGGGAGUCC | 5779 | GGACUCCCAGGCAGAAAAG | 5780 |
| UUUUCUGCCUGGGAGUCCU | 5781 | AGGACUCCCAGGCAGAAAA | 5782 |
| UUCUGCCUGGGAGUCCUGA | 5783 | UCAGGACUCCCAGGCAGAA | 5784 |
| UCUGCCUGGGAGUCCUGAC | 5785 | GUCAGGACUCCCAGGCAGA | 5786 |
| UGCCUGGGAGUCCUGACUU | 5787 | AAGUCAGGACUCCCAGGCA | 5788 |
| GCCUGGGAGUCCUGACUUC | 5789 | GAAGUCAGGACUCCCAGGC | 5790 |
| CUGGGAGUCCUGACUUCCA | 5791 | UGGAAGUCAGGACUCCCAG | 5792 |
| UGGGAGUCCUGACUUCCAC | 5793 | GUGGAAGUCAGGACUCCCA | 5794 |
| GGGAGUCCUGACUUCCACG | 5795 | CGUGGAAGUCAGGACUCCC | 5796 |
| GGAGUCCUGACUUCCACGA | 5797 | UCGUGGAAGUCAGGACUCC | 5798 |
| GAGUCCUGACUUCCACGAG | 5799 | CUCGUGGAAGUCAGGACUC | 5800 |
| AGUCCUGACUUCCACGAGG | 5801 | CCUCGUGGAAGUCAGGACU | 5802 |
| CCUGACUUCCACGAGGACC | 5803 | GGUCCUCGUGGAAGUCAGG | 5804 |
| CUGACUUCCACGAGGACCC | 5805 | GGGUCCUCGUGGAAGUCAG | 5806 |
| UGACUUCCACGAGGACCCA | 5807 | UGGGUCCUCGUGGAAGUCA | 5808 |
| GACUUCCACGAGGACCCAG | 5809 | CUGGGUCCUCGUGGAAGUC | 5810 |
| ACUUCCACGAGGACCCAGA | 5811 | UCUGGGUCCUCGUGGAAGU | 5812 |
| CuUCCACGAGGACCCAGAC | 5813 | GUCUGGGUCCUCGUGGAAG | 5814 |
| UUCCACGAGGACCCAGACC | 5815 | GGUCUGGGUCCUCGUGGAA | 5816 |
| CCCUGCUCCCAGUCAGUUG | 5817 | CAACUGACUGGGAGCAGGG | 5818 |
| CCUGCUCCCAGUCAGUUGA | 5819 | UCAACUGACUGGGAGCAGG | 5820 |
| CUGCUCCCAGUCAGUUGAC | 5821 | GUCAACUGACUGGGAGCAG | 5822 |
| UGCUCCCAGUCAGUUGACC | 5823 | GGUCAACUGACUGGGAGCA | 5824 |
| CCCAGUCAGUUGACCUGCC | 5825 | GGCAGGUCAACUGACUGGG | 5826 |
| CCAGUCAGUUGACCUGCCC | 5827 | GGGCAGGUCAACUGACUGG | 5828 |
| GCCUCCUUCCCAGAGCUCA | 5829 | UGAGCUCUGGGAAGGAGGC | 5830 |
| CCUCCUUCCCAGAGCUCAG | 5831 | CUGAGCUCUGGGAAGGAGG | 5832 |
| CUCCUUCCCAGAGCUCAGU | 5833 | ACUGAGCUCUGGGAAGGAG | 5834 |
| UCCUUCCCAGAGCUCAGUG | 5835 | CACUGAGCUCUGGGAAGGA | 5836 |
| CCUUCCCAGAGCUCAGUGG | 5837 | CCACUGAGCUCUGGGAAGG | 5838 |
| UUCCCAGAGCUCAGUGGUA | 5839 | UACCACUGAGCUCUGGGAA | 5840 |
| UCCCAGAGCUCAGUGGUAA | 5841 | UUACCACUGAGCUCUGGGA | 5842 |
| CAGGCUGUCACUAUCUCUA | 5843 | UAGAGAUAGUGACAGCCUG | 5844 |
| AGGCUGUCACUAUCUCUAC | 5845 | GUAGAGAUAGUGACAGCCU | 5846 |
| UCUCUACCACCACUCCUCU | 5847 | AGAGGAGUGGUGGUAGAGA | 5848 |
| CCACCACUCCUCUAGUCUG | 5849 | CAGACUAGAGGAGUGGUGG | 5850 |
| CACCACUCCUCUAGUCUGG | 5851 | CCAGACUAGAGGAGUGGUG | 5852 |
| ACCACUCCUCUAGUCUGGC | 5853 | GCCAGACUAGAGGAGUGGU | 5854 |
| CCACUCCUCUAGUCUGGCC | 5855 | GGCCAGACUAGAGGAGUGG | 5856 |
| CACUCCUCUAGUCUGGCCC | 5857 | GGGCCAGACUAGAGGAGUG | 5858 |
| AUUCUAGCACAUCUGGGCA | 5859 | UGCCCAGAUGUGCUAGAAU | 5860 |
| UUCUAGCACAUCUGGGCAA | 5861 | UUGCCCAGAUGUGCUAGAA | 5862 |
| UCUAGCACAUCUGGGCAAA | 5863 | UUUGCCCAGAUGUGCUAGA | 5864 |
| CUAGCACAUCUGGGCAAAA | 5865 | UUUUGCCCAGAUGUGCUAG | 5866 |
| GGGUGUAAAGGGACGUGCA | 5867 | UGCACGUCCCUUUACACCC | 5868 |
| GGUGUAAAGGGACGUGCAC | 5869 | GUGCACGUCCCUUUACACC | 5870 |
| GUGUAAAGGGACGUGCACA | 5871 | UGUGCACGUCCCUUUACAC | 5872 |
| UGUAAAGGGACGUGCACAG | 5873 | CUGUGCACGUCCCUUUACA | 5874 |
| GUAAAGGGACGUGCACAGA | 5875 | UCUGUGCACGUCCCUUUAC | 5876 |
| UAAAGGGACGUGCACAGAU | 5877 | AUCUGUGCACGUCCCUUUA | 5878 |

TABLE 9-continued

| Sense Sequence | SEQ ID NO: | Antisense Sequence | SEQ ID NO: |
|---|---|---|---|
| AAAGGGACGUGCACAGAUC | 5879 | GAUCUGUGCACGUCCCUUU | 5880 |
| AAGGGACGUGCACAGAUCU | 5881 | AGAUCUGUGCACGUCCCUU | 5882 |
| AGGGACGUGCACAGAUCUA | 5883 | UAGAUCUGUGCACGUCCU | 5884 |
| CGUGCACAGAUCUACUUAC | 5885 | GUAAGUAGAUCUGUGCACG | 5886 |
| GUGCACAGAUCUACUUACC | 5887 | GGUAAGUAGAUCUGUGCAC | 5888 |
| UGCACAGAUCUACUUACCA | 5889 | UGGUAAGUAGAUCUGUGCA | 5890 |
| GCACAGAUCUACUUACCAA | 5891 | UUGGUAAGUAGAUCUGUGC | 5892 |
| CACAGAUCUACUUACCAAG | 5893 | CUUGGUAAGUAGAUCUGUG | 5894 |
| ACAGAUCUACUUACCAAGC | 5895 | GCUUGGUAAGUAGAUCUGU | 5896 |
| CAGAUCUACUUACCAAGCU | 5897 | AGCUUGGUAAGUAGAUCUG | 5898 |
| AGAUCUACUUACCAAGCUG | 5899 | CAGCUUGGUAAGUAGAUCU | 5900 |
| AUCUACUUACCAAGCUGGG | 5901 | CCCAGCUUGGUAAGUAGAU | 5902 |
| UCUACUUACCAAGCUGGGA | 5903 | UCCCAGCUUGGUAAGUAGA | 5904 |
| CUUACCAAGCUGGGAGCAA | 5905 | UUGCUCCCAGCUUGGUAAG | 5906 |
| UUACCAAGCUGGGAGCAAG | 5907 | CUUGCUCCCAGCUUGGUAA | 5908 |
| UACCAAGCUGGGAGCAAGC | 5909 | GCUUGCUCCCAGCUUGGUA | 5910 |
| ACCAAGCUGGGAGCAAGCA | 5911 | UGCUUGCUCCCAGCUUGGU | 5912 |
| GCUGGGAGCAAGCAGGAUU | 5913 | AAUCCUGCUUGCUCCCAGC | 5914 |
| CUGGGAGCAAGCAGGAUUG | 5915 | CAAUCCUGCUUGCUCCCAG | 5916 |
| UGGGAGCAAGCAGGAUUGG | 5917 | CCAAUCCUGCUUGCUCCCA | 5918 |
| GGGAGCAAGCAGGAUUGGG | 5919 | CCCAAUCCUGCUUGCUCCC | 5920 |
| AAAGGUUAAGCAGCAGUAG | 5921 | CUACUGCUGCUUAACCUUU | 5922 |
| AAGGUUAAGCAGCAGUAGG | 5923 | CCUACUGCUGCUUAACCUU | 5924 |
| AGGUUAAGCAGCAGUAGGC | 5925 | GCCUACUGCUGCUUAACCU | 5926 |
| GGUGCCUACUCCUGUCCUG | 5927 | CAGGACAGGAGUAGGCACC | 5928 |
| GUGCCUACUCCUGUCCUGU | 5929 | ACAGGACAGGAGUAGGCAC | 5930 |
| UGCCUACUCCUGUCCUGUG | 5931 | CACAGGACAGGAGUAGGCA | 5932 |
| GCCUACUCCUGUCCUGUGC | 5933 | GCACAGGACAGGAGUAGGC | 5934 |
| CCUACUCCUGUCCUGUGCC | 5935 | GGCACAGGACAGGAGUAGG | 5936 |
| CUACUCCUGUCCUGUGCCU | 5937 | AGGCACAGGACAGGAGUAG | 5938 |
| UACUCCUGUCCUGUGCCUA | 5939 | UAGGCACAGGACAGGAGUA | 5940 |
| ACUCCUGUCCUGUGCCUAU | 5941 | AUAGGCACAGGACAGGAGU | 5942 |
| CUCCUGUCCUGUGCCUAUC | 5943 | GAUAGGCACAGGACAGGAG | 5944 |
| UCCUGUCCUGUGCCUAUCA | 5945 | UGAUAGGCACAGGACAGGA | 5946 |
| GUGCCUAUCACAUUUGCAG | 5947 | CUGCAAAUGUGAUAGGCAC | 5948 |
| CUAUCACAUUUGCAGAGGG | 5949 | CCCUCUGCAAAUGUGAUAG | 5950 |
| UAUCACAUUUGCAGAGGGU | 5951 | ACCCUCUGCAAAUGUGAUA | 5952 |
| AUCACAUUUGCAGAGGGUA | 5953 | UACCCUCUGCAAAUGUGAU | 5954 |
| UCACAUUUGCAGAGGGUAA | 5955 | UUACCCUCUGCAAAUGUGA | 5956 |
| CACAUUUGCAGAGGGUAAG | 5957 | CUUACCCUCUGCAAAUGUG | 5958 |
| ACAUUUGCAGAGGGUAAGA | 5959 | UCUUACCCUCUGCAAAUGU | 5960 |
| CUCACCCUGCUCCUUCCCA | 5961 | UGGGAAGGAGCAGGGUGAG | 5962 |
| CACCCUGCUCCUUCCCAUC | 5963 | GAUGGGAAGGAGCAGGGUG | 5964 |
| CCUGCUCCUUCCCAUCACC | 5965 | GGUGAUGGGAAGGAGCAGG | 5966 |
| UGCUCCUUCCCAUCACCAA | 5967 | UUGGUGAUGGGAAGGAGCA | 5968 |
| CAGUAAGAUUCCCUGGUGG | 5969 | CCACCAGGGAAUCUUACUG | 5970 |
| AGUAAGAUUCCCUGGUGGU | 5971 | ACCACCAGGGAAUCUUACU | 5972 |
| GUAAGAUUCCCUGGUGGUG | 5973 | CACCACCAGGGAAUCUUAC | 5974 |
| UAAGAUUCCCUGGUGGUGG | 5975 | CCACCACCAGGGAAUCUUA | 5976 |
| AAGAUUCCCUGGUGGUGGA | 5977 | UCCACCACCAGGGAAUCUU | 5978 |
| UCCCUGGUGGUGGAAGGAA | 5979 | UUCCUUCCACCACCAGGGA | 5980 |
| UCUGCUGAAUCCUGGUCCU | 5981 | AGGACCAGGAUUCAGCAGA | 5982 |
| CUGCUGAAUCCUGGUCCUG | 5983 | CAGGACCAGGAUUCAGCAG | 5984 |
| UGCUGAAUCCUGGUCCUGC | 5985 | GCAGGACCAGGAUUCAGCA | 5986 |
| GCUGAAUCCUGGUCCUGCUUC | 5987 | GAAGCAGGACCAGGAUUCA | 5988 |
| GAAUCCUGGUCCUGCUUCU | 5989 | AGAAGCAGGACCAGGAUUC | 5990 |
| AAUCCUGGUCCUGCUUCUG | 5991 | CAGAAGCAGGACCAGGAUU | 5992 |
| AUCCUGGUCCUGCUUCUGU | 5993 | ACAGAAGCAGGACCAGGAU | 5994 |
| UCCUGGUCCUGCUUCUGUU | 5995 | AACAGAAGCAGGACCAGGA | 5996 |
| CCUGGUCCUGCUUCUGUUC | 5997 | GAACAGAAGCAGGACCAGG | 5998 |
| CUGGUCCUGCUUCUGUUCU | 5999 | AGAACAGAAGCAGGACCAG | 6000 |
| UUCUGUUCUCAUCCCUCCC | 6001 | GGGAGGGAUGAGAACAGAA | 6002 |
| CUUCUGCAGUGUGUAUGUU | 6003 | AACAUACACACUGCAGAAG | 6004 |
| UUCUGCAGUGUGUAUGUUG | 6005 | CAACAUACACACUGCAGAA | 6006 |
| UCUGCAGUGUGUAUGUUGC | 6007 | GCAACAUACACACUGCAGA | 6008 |
| CUGCAGUGUGUAUGUUGCC | 6009 | GGCAACAUACACACUGCAG | 6010 |
| UGCAGUGUGUAUGUUGCCU | 6011 | AGGCAACAUACACACUGCA | 6012 |
| GCAGUGUGUAUGUUGCCUG | 6013 | CAGGCAACAUACACACUGC | 6014 |
| CAGUGUGUAUGUUGCCUGG | 6015 | CCAGGCAACAUACACACUG | 6016 |
| AGUGUGUAUGUUGCCUGGU | 6017 | ACCAGGCAACAUACACACU | 6018 |
| GUGUGUAUGUUGCCUGGUC | 6019 | GACCAGGCAACAUACACAC | 6020 |
| UGUGUAUGUUGCCUGGUCU | 6021 | AGACCAGGCAACAUACACA | 6022 |
| GUGUAUGUUGCCUGGUCUC | 6023 | GAGACCAGGCAACAUACAC | 6024 |
| UGUAUGUUGCCUGGUCUCU | 6025 | AGAGACCAGGCAACAUACA | 6026 |
| GUAUGUUGCCUGGUCUCUC | 6027 | GAGAGACCAGGCAACAUAC | 6028 |
| UAUGUUGCCUGGUCUCUCU | 6029 | AGAGAGACCAGGCAACAUA | 6030 |

TABLE 9-continued

| Sense Sequence | SEQ ID NO: | Antisense Sequence | SEQ ID NO: |
|---|---|---|---|
| AUGUUGCCUGGUCUCUCUG | 6031 | CAGAGAGACCAGGCAACAU | 6032 |
| UGUUGCCUGGUCUCUCUGG | 6033 | CCAGAGAGACCAGGCAACA | 6034 |
| GUUGCCUGGUCUCUCUGGC | 6035 | GCCAGAGAGACCAGGCAAC | 6036 |
| UUGCCUGGUCUCUCUGGCC | 6037 | GGCCAGAGAGACCAGGCAA | 6038 |
| CUGGUCUCUCUGGCCUGCA | 6039 | UGCAGGCCAGAGAGACCAG | 6040 |
| CCUGCAGAGGUGACCCAAA | 6041 | UUUGGGUCACCUCUGCAGG | 6042 |
| CUGCCUUAUCCUUGCCUGU | 6043 | ACAGGCAAGGAUAAGGCAG | 6044 |
| UGCCUUAUCCUUGCCUGUU | 6045 | AACAGGCAAGGAUAAGGCA | 6046 |
| GCCUUAUCCUUGCCUGUUU | 6047 | AAACAGGCAAGGAUAAGGC | 6048 |
| AGUCUCCUGGUCCGGCUGA | 6049 | UCAGCCGGACCAGGAGACU | 6050 |
| GUCAAUGACAGCUUUUCCA | 6051 | UGGAAAAGCUGUCAUUGAC | 6052 |
| UGACAGCUUUUCCAUGUAA | 6053 | UUACAUGGAAAAGCUGUCA | 6054 |
| GACAGCUUUUCCAUGUAAG | 6055 | CUUACAUGGAAAAGCUGUC | 6056 |
| ACAGCUUUUCCAUGUAAGG | 6057 | CCUUACAUGGAAAAGCUGU | 6058 |
| CAGCUUUUCCAUGUAAGGC | 6059 | GCCUUACAUGGAAAAGCUG | 6060 |
| AGCUUUUCCAUGUAAGGCA | 6061 | UGCCUUACAUGGAAAAGCU | 6062 |
| UGUAAGGCAUGGUGCUAGG | 6063 | CCUAGCACCAUGCCUUACA | 6064 |
| GUAAGGCAUGGUGCUAGGU | 6066 | ACCUAGCACCAUGCCUUAC | 6066 |
| UAAGGCAUGGUGCUAGGUU | 6067 | AACCUAGCACCAUGCCUUA | 6068 |
| GCAUGGUGCUAGGUUCCAG | 6069 | CUGGAACCUAGCACCAUGC | 6070 |
| CAUGGUGCUAGGUUCCAGG | 6071 | CCUGGAACCUAGCACCAUG | 6072 |
| AUGGUGCUAGGUUCCAGGA | 6073 | UCCUGGAACCUAGCACCAU | 6074 |
| UGGUGCUAGGUUCCAGGAG | 6076 | CUCCUGGAACCUAGCACCA | 6076 |
| GGUGCUAGGUUCCAGGAGG | 6077 | CCUCCUGGAACCUAGCACC | 6078 |
| GUGCUAGGUUCCAGGAGGA | 6079 | UCCUCCUGGAACCUAGCAC | 6080 |
| UGCAUGGAGGCAUAAUGGU | 6081 | ACCAUUAUGCCUCCAUGCA | 6082 |
| GCAUGGAGGCAUAAUGGUU | 6083 | AACCAUUAUGCCUCCAUGC | 6084 |
| CAUGGAGGCAUAAUGGUUA | 6086 | UAACCAUUAUGCCUCCAUG | 6086 |
| AUGGAGGCAUAAUGGUUAG | 6087 | CUAACCAUUAUGCCUCCAU | 6088 |
| UGGAGGCAUAAUGGUUAGG | 6089 | CCUAACCAUUAUGCCUCCA | 6090 |
| GGAGGCAUAAUGGUUAGGG | 6091 | CCCUAACCAUUAUGCCUCC | 6092 |
| GAGGCAUAAUGGUUAGGGA | 6093 | UCCCUAACCAUUAUGCCUC | 6094 |
| CAUAAUGGUUAGGGAGUCA | 6096 | UGACUCCCUAACCAUUAUG | 6096 |
| AUAAUGGUUAGGGAGUCAU | 6097 | AUGACUCCCUAACCAUUAU | 6098 |
| UAAUGGUUAGGGAGUCAUG | 6099 | CAUGACUCCCUAACCAUUA | 6100 |
| GGUUAGGGAGUCAUGACAC | 6101 | GUGUCAUGACUCCCUAACC | 6102 |
| CAUUACCAGGCUGCACCAG | 6103 | CUGGUGCAGCCUGGUAAUG | 6104 |
| AUUACCAGGCUGCACCAGG | 6105 | CCUGGUGCAGCCUGGUAAU | 6106 |
| UACCAGGCUGCACCAGGAU | 6107 | AUCCUGGUGCAGCCUGGUA | 6108 |
| ACCAGGCUGCACCAGGAUA | 6109 | UAUCCUGGUGCAGCCUGGU | 6110 |
| CCAGGCUGCACCAGGAUAC | 6111 | GUAUCCUGGUGCAGCCUGG | 6112 |
| AAAGGAUGAGUAGGGACAU | 6113 | AUGUCCCUACUCAUCCUUU | 6114 |
| AAGGAUGAGUAGGGACAUA | 6116 | UAUGUCCCUACUCAUCCUU | 6116 |
| AGGAUGAGUAGGGACAUAC | 6117 | GUAUGUCCCUACUCAUCCU | 6118 |
| GUAGGGACAUACUAAGAAG | 6119 | CUUCUUAGUAUGUCCCUAC | 6120 |
| GGACAUACUAAGAAGCAGC | 6121 | GCUGCUUCUUAGUAUGUCC | 6122 |
| AUACUAAGAAGCAGCCCUC | 6123 | GAGGGCUGCUUCUUAGUAU | 6124 |
| UACUAAGAAGCAGCCCUCU | 6125 | AGAGGGCUGCUUCUUAGUA | 6126 |
| ACUAAGAAGCAGCCCUCUC | 6127 | GAGAGGGCUGCUUCUUAGU | 6128 |
| AGAAGCAGCCCUCUCCUCU | 6129 | AGAGGAGAGGGCUGCUUCU | 6130 |
| GAAGCAGCCCUCUCCUCUU | 6131 | AAGAGGAGAGGGCUGCUUC | 6132 |
| CAGCCCUCUCCUCUUGGAA | 6133 | UUCCAAGAGGAGAGGGCUG | 6134 |
| GCCUGGCAGAUGGAUAGAG | 6136 | CUCUAUCCAUCUGCCAGGC | 6136 |
| CCUGGCAGAUGGAUAGAGC | 6137 | GCUCUAUCCAUCUGCCAGG | 6138 |
| CUGGCAGAUGGAUAGAGCU | 6139 | AGCUCUAUCCAUCUGCCAG | 6140 |
| UGGCAGAUGGAUAGAGCUG | 6141 | CAGCUCUAUCCAUCUGCCA | 6142 |
| GGCAGAUGGAUAGAGCUGG | 6143 | CCAGCUCUAUCCAUCUGCC | 6144 |
| GCAGAUGGAUAGAGCUGGG | 6145 | CCCAGCUCUAUCCAUCUGC | 6146 |
| AAAGGCCUCUGCUCAAGUA | 6147 | UACUUGAGCAGAGGCCUUU | 6148 |
| AAGGCCUCUGCUCAAGUAA | 6149 | UUACUUGAGCAGAGGCCUU | 6150 |
| AGGCCUCUGCUCAAGUAAC | 6151 | GUUACUUGAGCAGAGGCCU | 6152 |
| CAGGAGCACUGUCUUAGUU | 6153 | AACUAAGACAGUGCUCCUG | 6154 |
| AGGAGCACUGUCUUAGUUU | 6155 | AAACUAAGACAGUGCUCCU | 6156 |
| GGAGCACUGUCUUAGUUUG | 6157 | CAAACUAAGACAGUGCUCC | 6158 |
| GAGCACUGUCUUAGUUUGG | 6159 | CCAAACUAAGACAGUGCUC | 6160 |
| AGCACUGUCUUAGUUUGGG | 6161 | CCCAAACUAAGACAGUGCU | 6162 |
| GUUCUUCCAAAGCAGAGCU | 6163 | AGCUCUGCUUUGGAAGAAC | 6164 |
| AGCAGAGCUUGAGCUAAGG | 6165 | CCUUAGCUCAAGCUCUGCU | 6166 |
| GCAGAGCUUGAGCUAAGGG | 6167 | CCCUUAGCUCAAGCUCUGC | 6168 |
| CAGAGCUUGAGCUAAGGGC | 6169 | GCCCUUAGCUCAAGCUCUG | 6170 |
| GCUUGAGCUAAGGGCUUGG | 6171 | CCAAGCCCUUAGCUCAAGC | 6172 |
| UUGAGCUAAGGGCUUGGGU | 6173 | ACCCAAGCCCUUAGCUCAA | 6174 |
| UGAGCUAAGGGCUUGGGUA | 6175 | UACCCAAGCCCUUAGCUCA | 6176 |
| GAGCUAAGGGCUUGGGUAC | 6177 | GUACCCAAGCCCUUAGCUC | 6178 |
| AGCUAAGGGCUUGGGUACA | 6179 | UGUACCCAAGCCCUUAGCU | 6180 |
| GCUAAGGGCUUGGGUACAG | 6181 | CUGUACCCAAGCCCUUAGC | 6182 |

TABLE 9-continued

| Sense Sequence | SEQ ID NO: | Antisense Sequence | SEQ ID NO: |
|---|---|---|---|
| AGGGCUUGGGUACAGGUGA | 6183 | UCACCUGUACCCAAGCCCU | 6184 |
| GGGCUUGGGUACAGGUGAU | 6185 | AUCACCUGUACCCAAGCCC | 6186 |
| GGCUUGGGUACAGGUGAUC | 6187 | GAUCACCUGUACCCAAGCC | 6188 |
| GCUUGGGUACAGGUGAUCC | 6189 | GGAUCACCUGUACCCAAGC | 6190 |
| AGGUGAUCCUGUAUUCUUG | 6191 | CAAGAAUACAGGAUCACCU | 6192 |
| GGUGAUCCUGUAUUCUUGA | 6193 | UCAAGAAUACAGGAUCACC | 6194 |
| GUGAUCCUGUAUUCUUGAG | 6195 | CUCAAGAAUACAGGAUCAC | 6196 |
| UGAUCCUGUAUUCUUGAGC | 6197 | GCUCAAGAAUACAGGAUCA | 6198 |
| UCCUGUAUUCUUGAGCUAA | 6199 | UUAGCUCAAGAAUACAGGA | 6200 |
| CCUGUAUUCUUGAGCUAAG | 6201 | CUUAGCUCAAGAAUACAGG | 6202 |
| UGUAUUCUUGAGCUAAGGG | 6203 | CCCUUAGCUCAAGAAUACA | 6204 |
| GUAUUCUUGAGCUAAGGGC | 6205 | GCCCUUAGCUCAAGAAUAC | 6206 |
| UCUUGAGCUAAGGGCUUGG | 6207 | CCAAGCCCUUAGCUCAAGA | 6208 |
| UUGAGCUAAGGGCUUGGGU | 6209 | ACCCAAGCCCUUAGCUCAA | 6210 |
| UGAGCUAAGGGCUUGGGUA | 6211 | UACCCAAGCCCUUAGCUCA | 6212 |
| GAGCUAAGGGCUUGGGUAC | 6213 | GUACCCAAGCCCUUAGCUC | 6214 |
| AGCUAAGGGCUUGGGUACA | 6215 | UGUACCCAAGCCCUUAGCU | 6216 |
| GCUAAGGGCUUGGGUACAG | 6217 | CUGUACCCAAGCCCUUAGC | 6218 |
| AGGGCUUGGGUACAGGUGA | 6219 | UCACCUGUACCCAAGCCCU | 6220 |
| GGGCUUGGGUACAGGUGAU | 6221 | AUCACCUGUACCCAAGCCC | 6222 |
| GGCUUGGGUACAGGUGAUC | 6223 | GAUCACCUGUACCCAAGCC | 6224 |
| GCUUGGGUACAGGUGAUCC | 6225 | GGAUCACCUGUACCCAAGC | 6226 |
| AGGUGAUCCUGUAUUUGGG | 6227 | CCCAAAUACAGGAUCACCU | 6228 |
| GGUGAUCCUGUAUUUGGGA | 6229 | UCCCAAAUACAGGAUCACC | 6230 |
| AUCCUGUAUUUGGGAGGUU | 6231 | AACCUCCCAAAUACAGGAU | 6232 |
| UCCUGUAUUUGGGAGGUUA | 6233 | UAACCUCCCAAAUACAGGA | 6234 |
| CCUGUAUUUGGGAGGUUAA | 6235 | UUAACCUCCCAAAUACAGG | 6236 |
| CUGUAUUUGGGAGGUUAAC | 6237 | GUUAACCUCCCAAAUACAG | 6238 |
| UGUAUUUGGGAGGUUAACU | 6239 | AGUUAACCUCCCAAAUACA | 6240 |
| GUAUUUGGGAGGUUAACUC | 6241 | GAGUUAACCUCCCAAAUAC | 6242 |
| UAUUUGGGAGGUUAACUCA | 6243 | UGAGUUAACCUCCCAAAUA | 6244 |
| GGAGGUUAACUCAGGAAGU | 6245 | ACUUCCUGAGUUAACCUCC | 6246 |
| GAGGUUAACUCAGGAAGUG | 6247 | CACUUCCUGAGUUAACCUC | 6248 |
| AGGUUAACUCAGGAAGUGA | 6249 | UCACUUCCUGAGUUAACCU | 6250 |
| UCAGGAAGUGAGGGCAUAA | 6251 | UUAUGCCCUCACUUCCUGA | 6252 |
| CAGGAAGUGAGGGCAUAAG | 6253 | CUUAUGCCCUCACUUCCUG | 6254 |
| AGGAAGUGAGGGCAUAAGG | 6255 | CCUUAUGCCCUCACUUCCU | 6256 |
| GGAAGUGAGGGCAUAAGGU | 6257 | ACCUUAUGCCCUCACUUCC | 6258 |
| GAAGUGAGGGCAUAAGGUA | 6259 | UACCUUAUGCCCUCACUUC | 6260 |
| AAGUGAGGGCAUAAGGUAA | 6261 | UUACCUUAUGCCCUCACUU | 6262 |
| AGUGAGGGCAUAAGGUAAA | 6263 | UUUACCUUAUGCCCUCACU | 6264 |
| AAAGCCAUUAAGAGUAUGU | 6265 | ACAUACUCUUAAUGGCUUU | 6266 |
| AAGCCAUUAAGAGUAUGUU | 6267 | AACAUACUCUUAAUGGCUU | 6268 |
| AGCCAUUAAGAGUAUGUUA | 6269 | UAACAUACUCUUAAUGGCU | 6270 |
| UAAGAGUAUGUUAAGUCCC | 6271 | GGGACUUAACAUACUCUUA | 6272 |
| AAGAGUAUGUUAAGUCCCU | 6273 | AGGGACUUAACAUACUCUU | 6274 |
| AGAGUAUGUUAAGUCCCUU | 6275 | AAGGGACUUAACAUACUCU | 6276 |
| GAGUAUGUUAAGUCCCUUC | 6277 | GAAGGGACUUAACAUACUC | 6278 |
| AGUAUGUUAAGUCCCUUCA | 6279 | UGAAGGGACUUAACAUACU | 6280 |
| GUAUGUUAAGUCCCUUCAG | 6281 | CUGAAGGGACUUAACAUAC | 6282 |
| UAUGUUAAGUCCCUUCAGU | 6283 | ACUGAAGGGACUUAACAUA | 6284 |
| AUGUUAAGUCCCUUCAGUA | 6285 | UACUGAAGGGACUUAACAU | 6286 |
| UGUUAAGUCCCUUCAGUAG | 6287 | CUACUGAAGGGACUUAACA | 6288 |
| GUUAAGUCCCUUCAGUAGG | 6289 | CCUACUGAAGGGACUUAAC | 6290 |
| UUAAGUCCCUUCAGUAGGC | 6291 | GCCUACUGAAGGGACUUAA | 6292 |
| UAAGUCCCUUCAGUAGGCC | 6293 | GGCCUACUGAAGGGACUUA | 6294 |
| AAGUCCCUUCAGUAGGCCU | 6295 | AGGCCUACUGAAGGGACUU | 6296 |
| AGUCCCUUCAGUAGGCCUU | 6297 | AAGGCCUACUGAAGGGACU | 6298 |
| GUCCCUUCAGUAGGCCUUG | 6299 | CAAGGCCUACUGAAGGGAC | 6300 |
| UCCCUUCAGUAGGCCUUGG | 6301 | CCAAGGCCUACUGAAGGGA | 6302 |
| CCCUUCAGUAGGCCUUGGG | 6303 | CCCAAGGCCUACUGAAGGG | 6304 |
| CCUUCAGUAGGCCUUGGGA | 6305 | UCCCAAGGCCUACUGAAGG | 6306 |
| CUUCAGUAGGCCUUGGGAA | 6307 | UUCCCAAGGCCUACUGAAG | 6308 |
| AAAAGUAUAGAUUGCCCAA | 6309 | UUGGGCAAUCUAUACUUUU | 6310 |
| AAAGUAUAGAUUGCCCAAG | 6311 | CUUGGGCAAUCUAUACUUU | 6312 |
| AAGUAUAGAUUGCCCAAGA | 6313 | UCUUGGGCAAUCUAUACUU | 6314 |
| AAAGACUGGCAGGGUGAUC | 6315 | GAUCACCCUGCCAGUCUUU | 6316 |
| AAGACUGGCAGGGUGAUCA | 6317 | UGAUCACCCUGCCAGUCUU | 6318 |
| CUGGCAGGGUGAUCAGUCC | 6319 | GGACUGAUCACCCUGCCAG | 6320 |
| GAAUGUACUUAAUGAGUGG | 6321 | CCACUCAUUAAGUACAUUC | 6322 |
| AAUGUACUUAAUGAGUGGG | 6323 | CCCACUCAUUAAGUACAUU | 6324 |
| UGUACUUAAUGAGUGGGCU | 6325 | AGCCCACUCAUUAAGUACA | 6326 |
| GUACUUAAUGAGUGGGCUA | 6327 | UAGCCCACUCAUUAAGUAC | 6328 |
| UACUUAAUGAGUGGGCUAC | 6329 | GUAGCCCACUCAUUAAGUA | 6330 |
| CUUAAUGAGUGGGCUACAG | 6331 | CUGUAGCCCACUCAUUAAG | 6332 |
| UAAUGAGUGGGCUACAGCG | 6333 | CGCUGUAGCCCACUCAUUA | 6334 |

TABLE 9-continued

| Sense Sequence | SEQ ID NO: | Antisense Sequence | SEQ ID NO: |
|---|---|---|---|
| AAUGAGUGGGCUACAGCGU | 6335 | ACGCUGUAGCCCACUCAUU | 6336 |
| AUGAGUGGGCUACAGCGUA | 6337 | UACGCUGUAGCCCACUCAU | 6338 |
| UGAGUGGGCUACAGCGUAU | 6339 | AUACGCUGUAGCCCACUCA | 6340 |
| GAGUGGGCUACAGCGUAUC | 6341 | GAUACGCUGUAGCCCACUC | 6342 |
| AGUGGGCUACAGCGUAUCC | 6343 | GGAUACGCUGUAGCCCACU | 6344 |
| GUGGGCUACAGCGUAUCCU | 6345 | AGGAUACGCUGUAGCCCAC | 6346 |
| UGGGCUACAGCGUAUCCUC | 6347 | GAGGAUACGCUGUAGCCCA | 6348 |
| AGAGUUGUUCUACCUGGGU | 6349 | ACCCAGGUAGAACAACUCU | 6350 |
| GAGUUGUUCUACCUGGGUA | 6351 | UACCCAGGUAGAACAACUC | 6352 |
| AGUUGUUCUACCUGGGUAU | 6353 | AUACCCAGGUAGAACAACU | 6354 |
| GUUGUUCUACCUGGGUAUA | 6355 | UAUACCCAGGUAGAACAAC | 6356 |
| UUGUUCUACCUGGGUAUAU | 6357 | AUAUACCCAGGUAGAACAA | 6358 |
| UGUUCUACCUGGGUAUAUC | 6359 | GAUAUACCCAGGUAGAACA | 6360 |
| GUUCUACCUGGGUAUAUCC | 6361 | GGAUAUACCCAGGUAGAAC | 6362 |
| UACCUGGGUAUAUCCAAAA | 6363 | UUUUGGAUAUACCCAGGUA | 6364 |
| AGGGUAUGGAGUUUACGAG | 6365 | CUCGUAAACUCCAUACCCU | 6366 |
| GGGUAUGGAGUUUACGAGG | 6367 | CCUCGUAAACUCCAUACCC | 6368 |
| GGUAUGGAGUUUACGAGGG | 6369 | CCCUCGUAAACUCCAUACC | 6370 |
| GUAUGGAGUUUACGAGGGU | 6371 | ACCCUCGUAAACUCCAUAC | 6372 |
| UAUGGAGUUUACGAGGGUU | 6373 | AACCCUCGUAAACUCCAUA | 6374 |
| AUGGAGUUUACGAGGGUUC | 6375 | GAACCCUCGUAAACUCCAU | 6376 |
| UGGAGUUUACGAGGGUUCA | 6377 | UGAACCCUCGUAAACUCCA | 6378 |
| GGAGUUUACGAGGGUUCAA | 6379 | UUGAACCCUCGUAAACUCC | 6380 |
| GAGUUUACGAGGGUUCAAG | 6381 | CUUGAACCCUCGUAAACUC | 6382 |
| AGUUUACGAGGGUUCAAGG | 6383 | CCUUGAACCCUCGUAAACU | 6384 |
| GUUUACGAGGGUUCAAGGU | 6385 | ACCUUGAACCCUCGUAAAC | 6386 |
| UUUACGAGGGUUCAAGGUA | 6387 | UACCUUGAACCCUCGUAAA | 6388 |
| CGAGGGUUCAAGGUAUUUG | 6389 | CAAAUACCUUGAACCCUCG | 6390 |
| GAGGGUUCAAGGUAUUUGG | 6391 | CCAAAUACCUUGAACCCUC | 6392 |
| AGGGUUCAAGGUAUUUGGU | 6393 | ACCAAAUACCUUGAACCCU | 6394 |
| GGGUUCAAGGUAUUUGGUU | 6395 | AACCAAAUACCUUGAACCC | 6396 |
| GGUUCAAGGUAUUUGGUUC | 6397 | GAACCAAAUACCUUGAACC | 6398 |
| GUUCAAGGUAUUUGGUUCA | 6399 | UGAACCAAAUACCUUGAAC | 6400 |
| UUCAAGGUAUUUGGUUCAG | 6401 | CUGAACCAAAUACCUUGAA | 6402 |
| UCAAGGUAUUUGGUUCAGG | 6403 | CCUGAACCAAAUACCUUGA | 6404 |
| CAACUGGCCAGGUCACAGG | 6405 | CCUGUGACCUGGCCAGUUG | 6406 |
| GCCAGGUCACAGGGCAAUC | 6407 | GAUUGCCCUGUGACCUGGC | 6408 |
| CCAGGUCACAGGGCAAUCA | 6409 | UGAUUGCCCUGUGACCUGG | 6410 |
| AGGUCACAGGGCAAUCAAG | 6411 | CUUGAUUGCCCUGUGACCU | 6412 |
| GGUCACAGGGCAAUCAAGU | 6413 | ACUUGAUUGCCCUGUGACC | 6414 |
| GUCACAGGGCAAUCAAGUU | 6415 | AACUUGAUUGCCCUGUGAC | 6416 |
| UCACAGGGCAAUCAAGUUA | 6417 | UAACUUGAUUGCCCUGUGA | 6418 |
| CACAGGGCAAUCAAGUUAC | 6419 | GUAACUUGAUUGCCCUGUG | 6420 |
| ACAGGGCAAUCAAGUUACU | 6421 | AGUAACUUGAUUGCCCUGU | 6422 |
| CAGGGCAAUCAAGUUACUC | 6423 | GAGUAACUUGAUUGCCCUG | 6424 |
| AGGGCAAUCAAGUUACUCU | 6425 | AGAGUAACUUGAUUGCCCU | 6426 |
| CAAUCAAGUUACUCUGUGU | 6427 | ACACAGAGUAACUUGAUUG | 6428 |
| AAUCAAGUUACUCUGUGUU | 6429 | AACACAGAGUAACUUGAUU | 6430 |
| AUCAAGUUACUCUGUGUUU | 6431 | AAACACAGAGUAACUUGAU | 6432 |
| ACUCUGUGUUUCUUUGUCA | 6433 | UGACAAAGAAACACAGAGU | 6434 |
| UCUGUGUUUCUUUGUCAGG | 6435 | CCUGACAAAGAAACACAGA | 6436 |
| UGUUUCUUUGUCAGGACAC | 6437 | GUGUCCUGACAAAGAAACA | 6438 |
| AAAGCAGGGAUUGUGUUCA | 6439 | UGAACACAAUCCCUGCUUU | 6440 |
| AAGCAGGGAUUGUGUUCAU | 6441 | AUGAACACAAUCCCUGCUU | 6442 |
| AGCAGGGAUUGUGUUCAUU | 6443 | AAUGAACACAAUCCCUGCU | 6444 |
| GCAGGGAUUGUGUUCAUUU | 6445 | AAAUGAACACAAUCCCUGC | 6446 |
| CAGGGAUUGUGUUCAUUUG | 6447 | CAAAUGAACACAAUCCCUG | 6448 |
| AGGGAUUGUGUUCAUUUGA | 6449 | UCAAAUGAACACAAUCCCU | 6450 |
| GUGUUCAUUUGAGGGUUUC | 6451 | GAAACCCUCAAAUGAACAC | 6452 |
| UGUUCAUUUGAGGGUUUCA | 6453 | UGAAACCCUCAAAUGAACA | 6454 |
| GUUCAUUUGAGGGUUUCAC | 6455 | GUGAAACCCUCAAAUGAAC | 6456 |
| UUCAUUUGAGGGUUUCACU | 6457 | AGUGAAACCCUCAAAUGAA | 6458 |
| UCAUUUGAGGGUUUCACUG | 6459 | CAGUGAAACCCUCAAAUGA | 6460 |
| CAUUUGAGGGUUUCACUGU | 6461 | ACAGUGAAACCCUCAAAUG | 6462 |
| AGUCUCAGCUUCCAUGCAA | 6463 | UUGCAUGGAAGCUGAGACU | 6464 |
| UCUCAGCUUCCAUGCAACU | 6465 | AGUUGCAUGGAAGCUGAGA | 6466 |
| CUCAGCUUCCAUGCAACUG | 6467 | CAGUUGCAUGGAAGCUGAG | 6468 |
| UCAGCUUCCAUGCAACUGU | 6469 | ACAGUUGCAUGGAAGCUGA | 6470 |
| CAGCUUCCAUGCAACUGUC | 6471 | GACAGUUGCAUGGAAGCUG | 6472 |
| AGCUUCCAUGCAACUGUCC | 6473 | GGACAGUUGCAUGGAAGCU | 6474 |
| GCUUCCAUGCAACUGUCCA | 6475 | UGGACAGUUGCAUGGAAGC | 6476 |
| CUUCCAUGCAACUGUCCAU | 6477 | AUGGACAGUUGCAUGGAAG | 6478 |
| UUCCAUGCAACUGUCCAUC | 6479 | GAUGGACAGUUGCAUGGAA | 6480 |
| CCAUGCAACUGUCCAUCAC | 6481 | GUGAUGGACAGUUGCAUGG | 6482 |
| CAUGCAACUGUCCAUCACG | 6483 | CGUGAUGGACAGUUGCAUG | 6484 |
| AUGCAACUGUCCAUCACGG | 6485 | CCGUGAUGGACAGUUGCAU | 6486 |

TABLE 9-continued

| Sense Sequence | SEQ ID NO: | Antisense Sequence | SEQ ID NO: |
|---|---|---|---|
| UGCAACUGUCCAUCACGGC | 6487 | GCCGUGAUGGACAGUUGCA | 6488 |
| GCAACUGUCCAUCACGGCU | 6489 | AGCCGUGAUGGACAGUUGC | 6490 |
| CAACUGUCCAUCACGGCUG | 6491 | CAGCCGUGAUGGACAGUUG | 6492 |
| AACUGUCCAUCACGGCUGC | 6493 | GCAGCCGUGAUGGACAGUU | 6494 |
| ACUGUCCAUCACGGCUGCA | 6495 | UGCAGCCGUGAUGGACAGU | 6496 |
| CUGUCCAUCACGGCUGCAA | 6497 | UUGCAGCCGUGAUGGACAG | 6498 |
| UGUCCAUCACGGCUGCAAC | 6499 | GUUGCAGCCGUGAUGGACA | 6500 |
| GUCCAUCACGGCUGCAACU | 6501 | AGUUGCAGCCGUGAUGGAC | 6502 |
| UCCAUCACGGCUGCAACUG | 6503 | CAGUUGCAGCCGUGAUGGA | 6504 |
| CCAUCACGGCUGCAACUGA | 6505 | UCAGUUGCAGCCGUGAUGG | 6506 |
| CAUCACGGCUGCAACUGAA | 6507 | UUCAGUUGCAGCCGUGAUG | 6508 |
| ACAGCGCACCAGAAGCUAA | 6509 | UUAGCUUCUGGUGCGCUGU | 6510 |
| CAGCGCACCAGAAGCUAAA | 6511 | UUUAGCUUCUGGUGCGCUG | 6512 |
| AGCGCACCAGAAGCUAAAG | 6513 | CUUUAGCUUCUGGUGCGCU | 6514 |
| GCGCACCAGAAGCUAAAGU | 6515 | ACUUUAGCUUCUGGUGCGC | 6516 |
| CGCACCAGAAGCUAAAGUC | 6517 | GACUUUAGCUUCUGGUGCG | 6518 |
| GCACCAGAAGCUAAAGUCU | 6519 | AGACUUUAGCUUCUGGUGC | 6520 |
| CACCAGAAGCUAAAGUCUU | 6521 | AAGACUUUAGCUUCUGGUG | 6522 |
| ACCAGAAGCUAAAGUCUUG | 6523 | CAAGACUUUAGCUUCUGGU | 6524 |
| CCAGAAGCUAAAGUCUUGA | 6525 | UCAAGACUUUAGCUUCUGG | 6526 |
| CAGAAGCUAAAGUCUUGAU | 6527 | AUCAAGACUUUAGCUUCUG | 6528 |
| AGAAGCUAAAGUCUUGAUG | 6529 | CAUCAAGACUUUAGCUUCU | 6530 |
| GAAGCUAAAGUCUUGAUGC | 6531 | GCAUCAAGACUUUAGCUUC | 6532 |
| AAGCUAAAGUCUUGAUGCC | 6533 | GGCAUCAAGACUUUAGCUU | 6534 |
| AGCUAAAGUCUUGAUGCCA | 6535 | UGGCAUCAAGACUUUAGCU | 6536 |
| CCCAUUCACAUCUCUGUCA | 6537 | UGACAGAGAUGUGAAUGGG | 6538 |
| UUCACAUCUCUGUCACGUC | 6539 | GACGUGACAGAGAUGUGAA | 6540 |
| UCACAUCUCUGUCACGUCC | 6541 | GGACGUGACAGAGAUGUGA | 6542 |
| CACAUCUCUGUCACGUCCA | 6543 | UGGACGUGACAGAGAUGUG | 6544 |
| UCUCUGUCACGUCCACUAA | 6545 | UUAGUGGACGUGACAGAGA | 6546 |
| CUCUGUCACGUCCACUAAU | 6547 | AUUAGUGGACGUGACAGAG | 6548 |
| UCUGUCACGUCCACUAAUC | 6549 | GAUUAGUGGACGUGACAGA | 6550 |
| CUGUCACGUCCACUAAUCG | 6551 | CGAUUAGUGGACGUGACAG | 6552 |
| UGUCACGUCCACUAAUCGG | 6553 | CCGAUUAGUGGACGUGACA | 6554 |
| GUCACGUCCACUAAUCGGC | 6555 | GCCGAUUAGUGGACGUGAC | 6556 |
| UCACGUCCACUAAUCGGCA | 6557 | UGCCGAUUAGUGGACGUGA | 6558 |
| CACGUCCACUAAUCGGCAA | 6559 | UUGCCGAUUAGUGGACGUG | 6560 |
| ACGUCCACUAAUCGGCAAA | 6561 | UUUGCCGAUUAGUGGACGU | 6562 |
| CGUCCACUAAUCGGCAAAA | 6563 | UUUUGCCGAUUAGUGGACG | 6564 |
| GUCCACUAAUCGGCAAAAG | 6565 | CUUUUGCCGAUUAGUGGAC | 6566 |
| UCCACUAAUCGGCAAAAGG | 6567 | CCUUUUGCCGAUUAGUGGA | 6568 |
| CCACUAAUCGGCAAAAGGA | 6569 | UCCUUUUGCCGAUUAGUGG | 6570 |
| CACUAAUCGGCAAAAGGAG | 6571 | CUCCUUUUGCCGAUUAGUG | 6572 |
| AGAAGAUGACCUAAGUGUG | 6573 | CACACUUAGGUCAUCUUCU | 6574 |
| GAAGAUGACCUAAGUGUGA | 6575 | UCACACUUAGGUCAUCUUC | 6576 |
| AAGAUGACCUAAGUGUGAC | 6577 | GUCACACUUAGGUCAUCUU | 6578 |
| AGAUGACCUAAGUGUGACU | 6579 | AGUCACACUUAGGUCAUCU | 6580 |
| GAUGACCUAAGUGUGACUG | 6581 | CAGUCACACUUAGGUCAUC | 6582 |
| AUGACCUAAGUGUGACUGC | 6583 | GCAGUCACACUUAGGUCAU | 6584 |
| UGACCUAAGUGUGACUGCA | 6585 | UGCAGUCACACUUAGGUCA | 6586 |
| AAAAUGAAGCCAGAGCAGU | 6587 | ACUGCUCUGGCUUCAUUUU | 6588 |
| UCCGACCAAGGAGGAAGGA | 6589 | UCCUUCCUCCUUGGUCGGA | 6590 |
| CCGACCAAGGAGGAAGGAA | 6591 | UUCCUUCCUCCUUGGUCGG | 6592 |
| AGAGCAGGUAAGCAGGAAG | 6593 | CUUCCUGCUUACCUGCUCU | 6594 |
| GAGCAGGUAAGCAGGAAGG | 6595 | CCUUCCUGCUUACCUGCUC | 6596 |
| AGGUAAGCAGGAAGGCCAG | 6597 | CUGGCCUUCCUGCUUACCU | 6598 |
| AGCAGGAAGGCCAGUGUCC | 6599 | GGACACUGGCCUUCCUGCU | 6600 |
| CAGGAAGGCCAGUGUCCCA | 6601 | UGGGACACUGGCCUUCCUG | 6602 |
| UCCCAGACAGGACCCUAAU | 6603 | AUUAGGGUCCUGUCUGGGA | 6604 |
| CCCAGACAGGACCCUAAUG | 6605 | CAUUAGGGUCCUGUCUGGG | 6606 |
| CCAGACAGGACCCUAAUGA | 6607 | UCAUUAGGGUCCUGUCUGG | 6608 |
| CAGACAGGACCCUAAUGAU | 6609 | AUCAUUAGGGUCCUGUCUG | 6610 |
| AGACAGGACCCUAAUGAUC | 6611 | GAUCAUUAGGGUCCUGUCU | 6612 |
| GACAGGACCCUAAUGAUCC | 6613 | GGAUCAUUAGGGUCCUGUC | 6614 |
| GGACCCUAAUGAUCCUGAA | 6615 | UUCAGGAUCAUUAGGGUCC | 6616 |
| CCUAAUGAUCCUGAAUCCA | 6617 | UGGAUUCAGGAUCAUUAGG | 6618 |
| CUAAUGAUCCUGAAUCCAU | 6619 | AUGGAUUCAGGAUCAUUAG | 6620 |
| UGAUCCUGAAUCCAUGUAU | 6621 | AUACAUGGAUUCAGGAUCA | 6622 |
| GAUCCUGAAUCCAUGUAUC | 6623 | GAUACAUGGAUUCAGGAUC | 6624 |
| AUCCUGAAUCCAUGUAUCA | 6625 | UGAUACAUGGAUUCAGGAU | 6626 |
| UCCUGAAUCCAUGUAUCAG | 6627 | AUGGAUCCUGAUACAUGGA | 6628 |
| CCAUGUAUCAGGAUCCAUC | 6629 | GAUGGAUCCUGAUACAUGG | 6630 |
| CAUGUAUCAGGAUCCAUCC | 6631 | GGAUGGAUCCUGAUACAUG | 6632 |
| UCACCUCUCAUUUUCCAAA | 6633 | UUUGGAAAAUGAGAGGUGA | 6634 |
| UCCAAAGCCCUGCCAUGCU | 6635 | AGCAUGGCAGGGCUUUGGA | 6636 |
| CCAAAGCCCUGCCAUGCUG | 6637 | CAGCAUGGCAGGGCUUUGG | 6638 |

TABLE 9-continued

| Sense Sequence | SEQ ID NO: | Antisense Sequence | SEQ ID NO: |
|---|---|---|---|
| CAUGCUGCCAUCCCACUUC | 6639 | GAAGUGGGAUGGCAGCAUG | 6640 |
| AUGCUGCCAUCCCACUUCC | 6641 | GGAAGUGGGAUGGCAGCAU | 6642 |
| UGCUGCCAUCCCACUUCCC | 6643 | GGGAAGUGGGAUGGCAGCA | 6644 |
| CGGGUUCCCUUUUCCUAAA | 6645 | UUUAGGAAAAGGGAACCCG | 6646 |
| AGCUGCAGCUUAUGGCUUC | 6647 | GAAGCCAUAAGCUGCAGCU | 6648 |
| GCUGCAGCUUAUGGCUUCU | 6649 | AGAAGCCAUAAGCUGCAGC | 6650 |
| CUGCAGCUUAUGGCUUCUC | 6651 | GAGAAGCCAUAAGCUGCAG | 6652 |
| UGCAGCUUAUGGCUUCUCC | 6653 | GGAGAAGCCAUAAGCUGCA | 6654 |
| GCAGCUUAUGGCUUCUCCA | 6655 | UGGAGAAGCCAUAAGCUGC | 6656 |
| CAGCUUAUGGCUUCUCCAG | 6657 | CUGGAGAAGCCAUAAGCUG | 6658 |
| AGCUUAUGGCUUCUCCAGU | 6659 | ACUGGAGAAGCCAUAAGCU | 6660 |
| GCUUAUGGCUUCUCCAGUA | 6661 | UACUGGAGAAGCCAUAAGC | 6662 |
| CUUAUGGCUUCUCCAGUAG | 6663 | CUACUGGAGAAGCCAUAAG | 6664 |
| UUAUGGCUUCUCCAGUAGG | 6665 | CCUACUGGAGAAGCCAUAA | 6666 |
| UAUGGCUUCUCCAGUAGGU | 6667 | ACCUACUGGAGAAGCCAUA | 6668 |
| AUGGCUUCUCCAGUAGGUG | 6669 | CACCUACUGGAGAAGCCAU | 6670 |
| UGGCUUCUCCAGUAGGUGG | 6671 | CCACCUACUGGAGAAGCCA | 6672 |
| GGCUUCUCCAGUAGGUGGC | 6673 | GCCACCUACUGGAGAAGCC | 6674 |
| GCUUCUCCAGUAGGUGGCA | 6675 | UGCCACCUACUGGAGAAGC | 6676 |
| CUUCUCCAGUAGGUGGCAG | 6677 | CUGCCACCUACUGGAGAAG | 6678 |
| UUCUCCAGUAGGUGGCAGC | 6679 | GCUGCCACCUACUGGAGAA | 6680 |
| UCUCCAGUAGGUGGCAGCA | 6681 | UGCUGCCACCUACUGGAGA | 6682 |
| CUCCAGUAGGUGGCAGCAC | 6683 | GUGCUGCCACCUACUGGAG | 6684 |
| ACACCAGAAGUCACAUUUC | 6685 | GAAAUGUGACUUCUGGUGU | 6686 |
| GAAGUCACAUUUCAUCCUU | 6687 | AAGGAUGAAAUGUGACUUC | 6688 |
| AAGUCACAUUUCAUCCUUU | 6689 | AAAGGAUGAAAUGUGACUU | 6690 |
| AGUCACAUUUCAUCCUUUU | 6691 | AAAAGGAUGAAAUGUGACU | 6692 |
| UUUCAUCCUUUUACAUGGU | 6693 | ACCAUGUAAAAGGAUGAAA | 6694 |
| UUCAUCCUUUUACAUGGUU | 6695 | AACCAUGUAAAAGGAUGAA | 6696 |
| UCAUCCUUUUACAUGGUUC | 6697 | GAACCAUGUAAAAGGAUGA | 6698 |
| CAUCCUUUUACAUGGUUCC | 6699 | GGAACCAUGUAAAAGGAUG | 6700 |
| UGGUUCCCAUCUACCCUCA | 6701 | UGAGGGUAGAUGGGAACCA | 6702 |
| GGUUCCCAUCUACCCUCAC | 6703 | GUGAGGGUAGAUGGGAACC | 6704 |
| GUUCCCAUCUACCCUCACA | 6705 | UGUGAGGGUAGAUGGGAAC | 6706 |
| GGCAAUUCUUCCUCCAGGA | 6707 | UCCUGGAGGAAGAAUUGCC | 6708 |
| GCAAUUCUUCCUCCAGGAC | 6709 | GUCCUGGAGGAAGAAUUGC | 6710 |
| CAAUUCUUCCUCCAGGACC | 6711 | GGUCCUGGAGGAAGAAUUG | 6712 |
| AAUUCUUCCUCCAGGACCC | 6713 | GGGUCCUGGAGGAAGAAUU | 6714 |
| CCCUUGGACUUUGCCCUUC | 6715 | GAAGGGCAAAGUCCAAGGG | 6716 |
| CCUUGGACUUUGCCCUUCU | 6717 | AGAAGGGCAAAGUCCAAGG | 6718 |
| CUUGGACUUUGCCCUUCUU | 6719 | AAGAAGGGCAAAGUCCAAG | 6720 |
| UUGGACUUUGCCCUUCUUA | 6721 | UAAGAAGGGCAAAGUCCAA | 6722 |
| UGGACUUUGCCCUUCUUAC | 6723 | GUAAGAAGGGCAAAGUCCA | 6724 |
| GGACUUUGCCCUUCUUACU | 6725 | AGUAAGAAGGGCAAAGUCC | 6726 |
| UUUGCCCUUCUUACUGGCC | 6727 | GGCCAGUAAGAAGGGCAAA | 6728 |
| UUGCCCUUCUUACUGGCCA | 6729 | UGGCCAGUAAGAAGGGCAA | 6730 |
| UGCCCUUCUUACUGGCCAG | 6731 | CUGGCCAGUAAGAAGGGCA | 6732 |
| UCUUACUGGCCAGGCAGGG | 6733 | CCCUGCCUGGCCAGUAAGA | 6734 |
| GGCCAGAGUCCAGGCUUGA | 6735 | UCAAGCCUGGACUCUGGCC | 6736 |
| GCCAGAGUCCAGGCUUGAC | 6737 | GUCAAGCCUGGACUCUGGC | 6738 |
| GUCCAGGCUUGACUCAUUC | 6739 | GAAUGAGUCAAGCCUGGAC | 6740 |
| AGGCUUGACUCAUUCCCAC | 6741 | GUGGGAAUGAGUCAAGCCU | 6742 |
| GACUCAUUCCCACCUUGUC | 6743 | GACAAGGUGGGAAUGAGUC | 6744 |
| ACUCAUUCCCACCUUGUCC | 6745 | GGACAAGGUGGGAAUGAGU | 6746 |
| UCAUUCCCACCUUGUCCUG | 6747 | CAGGACAAGGUGGGAAUGA | 6748 |
| CACCUUGUCCUGGGCUGAG | 6749 | CUCAGCCCAGGACAAGGUG | 6750 |
| ACCACCCAGCCCAGAAGUU | 6751 | AACUUCUGGGCUGGGUGGU | 6752 |
| CCACCCAGCCCAGAAGUUC | 6753 | GAACUUCUGGGCUGGGUGG | 6754 |
| CACCCAGCCCAGAAGUUCC | 6755 | GGAACUUCUGGGCUGGGUG | 6756 |
| ACCCAGCCCAGAAGUUCCA | 6757 | UGGAACUUCUGGGCUGGGU | 6758 |
| CCAGAAGUUCCAGGGAAGG | 6759 | CCUUCCCUGGAACUUCUGG | 6760 |
| CAGAAGUUCCAGGGAAGGA | 6761 | UCCUUCCCUGGAACUUCUG | 6762 |
| AACUCUCCGGUCCACCAUG | 6763 | CAUGGUGGACCGGAGAGUU | 6764 |
| ACUCUCCGGUCCACCAUGG | 6765 | CCAUGGUGGACCGGAGAGU | 6766 |
| CACCAUGGAGUACCUCUCA | 6767 | UGAGAGGUACUCCAUGGUG | 6768 |
| ACCAUGGAGUACCUCUCAG | 6769 | CUGAGAGGUACUCCAUGGU | 6770 |
| UGGAGUACCUCUCAGCUCU | 6771 | AGAGCUGAGAGGUACUCCA | 6772 |
| GGAGUACCUCUCAGCUCUG | 6773 | CAGAGCUGAGAGGUACUCC | 6774 |
| GAGUACCUCUCAGCUCUGA | 6775 | UCAGAGCUGAGAGGUACUC | 6776 |
| AGUACCUCUCAGCUCUGAA | 6777 | UUCAGAGCUGAGAGGUACU | 6778 |
| CCAGUGACUUACUCAGGUG | 6779 | CACCUGAGUAAGUCACUGG | 6780 |
| CAGUGACUUACUCAGGUGA | 6781 | UCACCUGAGUAAGUCACUG | 6782 |
| AGUGACUUACUCAGGUGAC | 6783 | GUCACCUGAGUAAGUCACU | 6784 |
| GUGACUUACUCAGGUGACU | 6785 | AGUCACCUGAGUAAGUCAC | 6786 |
| UGACUUACUCAGGUGACUG | 6787 | CAGUCACCUGAGUAAGUCA | 6788 |
| GACUUACUCAGGUGACUGC | 6789 | GCAGUCACCUGAGUAAGUC | 6790 |

TABLE 9-continued

| Sense Sequence | SEQ ID NO: | Antisense Sequence | SEQ ID NO: |
|---|---|---|---|
| ACUUACUCAGGUGACUGCU | 6791 | AGCAGUCACCUGAGUAAGU | 6792 |
| CUUACUCAGGUGACUGCUA | 6793 | UAGCAGUCACCUGAGUAAG | 6794 |
| UUACUCAGGUGACUGCUAA | 6795 | UUAGCAGUCACCUGAGUAA | 6796 |
| UACUCAGGUGACUGCUAAC | 6797 | GUUAGCAGUCACCUGAGUA | 6798 |
| ACUCAGGUGACUGCUAACC | 6799 | GGUUAGCAGUCACCUGAGU | 6800 |
| CUCAGGUGACUGCUAACCC | 6801 | GGGUUAGCAGUCACCUGAG | 6802 |
| GGUGACUGCUAACCCUCCG | 6803 | CGGAGGGUUAGCAGUCACC | 6804 |
| GUGACUGCUAACCCUCCGC | 6805 | GCGGAGGGUUAGCAGUCAC | 6806 |
| UGACUGCUAACCCUCCGCU | 6807 | AGCGGAGGGUUAGCAGUCA | 6808 |
| GACUGCUAACCCUCCGCUC | 6809 | GAGCGGAGGGUUAGCAGUC | 6810 |
| ACUGCUAACCCUCCGCUCU | 6811 | AGAGCGGAGGGUUAGCAGU | 6812 |
| CUGCUAACCCUCCGCUCUA | 6813 | UAGAGCGGAGGGUUAGCAG | 6814 |
| UGCUAACCCUCCGCUCUAC | 6815 | GUAGAGCGGAGGGUUAGCA | 6816 |
| AACCCUCCGCUCUACCCUC | 6817 | GAGGGUAGAGCGGAGGGUU | 6818 |
| ACUCCACAGUGGGCUUGUC | 6819 | GACAAGCCCACUGUGGAGU | 6820 |
| CUCCACAGUGGGCUUGUCA | 6821 | UGACAAGCCCACUGUGGAG | 6822 |
| UCCACAGUGGGCUUGUCAA | 6823 | UUGACAAGCCCACUGUGGA | 6824 |
| CCACAGUGGGCUUGUCAAG | 6825 | CUUGACAAGCCCACUGUGG | 6826 |
| GUCAAGCUCCUGAGCCACC | 6827 | GGUGGCUCAGGAGCUUGAC | 6828 |
| CCAUGGUCUCUCCCUCAUC | 6829 | GAUGAGGGAGAGACCAUGG | 6830 |
| CAUGGUCUCUCCCUCAUCC | 6831 | GGAUGAGGGAGAGACCAUG | 6832 |
| AUGGUCUCUCCCUCAUCCC | 6833 | GGGAUGAGGGAGAGACCAU | 6834 |
| UCUCUCCCUCAUCCCUAAU | 6835 | AUUAGGGAUGAGGGAGAGA | 6836 |
| CUCUCCCUCAUCCCUAAUC | 6837 | GAUUAGGGAUGAGGGAGAG | 6838 |
| UCUCCCUCAUCCCUAAUCG | 6839 | CGAUUAGGGAUGAGGGAGA | 6840 |
| CUCCCUCAUCCCUAAUCGA | 6841 | UCGAUUAGGGAUGAGGGAG | 6842 |
| UCCCUCAUCCCUAAUCGAU | 6843 | AUCGAUUAGGGAUGAGGGA | 6844 |
| CCCUCAUCCCUAAUCGAUA | 6845 | UAUCGAUUAGGGAUGAGGG | 6846 |
| CCUCAUCCCUAAUCGAUAA | 6847 | UUAUCGAUUAGGGAUGAGG | 6848 |
| CUCAUCCCUAAUCGAUAAA | 6849 | UUUAUCGAUUAGGGAUGAG | 6850 |
| AACCUAGAUCUCUCCCUCC | 6851 | GGAGGGAGAGAUCUAGGUU | 6852 |
| ACCUAGAUCUCUCCCUCCC | 6853 | GGGAGGGAGAGAUCUAGGU | 6854 |
| CUAGAUCUCUCCCUCCCUA | 6855 | UAGGGAGGGAGAGAUCUAG | 6856 |
| UAGAUCUCUCCCUCCCUAG | 6857 | CUAGGGAGGGAGAGAUCUA | 6858 |
| AGAUCUCUCCCUCCCUAGC | 6859 | GCUAGGGAGGGAGAGAUCU | 6860 |
| GAUCUCUCCCUCCCUAGCC | 6861 | GGCUAGGGAGGGAGAGAUC | 6862 |
| AUCUCUCCCUCCCUAGCCC | 6863 | GGGCUAGGGAGGGAGAGAU | 6864 |
| UAGCCCUCUAGCCACUCUA | 6865 | UAGAGUGGCUAGAGGGCUA | 6866 |
| AGCCCUCUAGCCACUCUAC | 6867 | GUAGAGUGGCUAGAGGGCU | 6868 |
| CUCUAGCCACUCUACCCUC | 6869 | GAGGGUAGAGUGGCUAGAG | 6870 |
| UCUAGCCACUCUACCCUCA | 6871 | UGAGGGUAGAGUGGCUAGA | 6872 |
| CUAGCCACUCUACCCUCAU | 6873 | AUGAGGGUAGAGUGGCUAG | 6874 |
| UAGCCACUCUACCCUCAUC | 6875 | GAUGAGGGUAGAGUGGCUA | 6876 |
| AGCCACUCUACCCUCAUCA | 6877 | UGAUGAGGGUAGAGUGGCU | 6878 |
| GCCACUCUACCCUCAUCAU | 6879 | AUGAUGAGGGUAGAGUGGC | 6880 |
| CCACUCUACCCUCAUCAUG | 6881 | CAUGAUGAGGGUAGAGUGG | 6882 |
| CACUCUACCCUCAUCAUGC | 6883 | GCAUGAUGAGGGUAGAGUG | 6884 |
| ACUCUACCCUCAUCAUGCC | 6885 | GGCAUGAUGAGGGUAGAGU | 6886 |
| CUCUACCCUCAUCAUGCCC | 6887 | GGGCAUGAUGAGGGUAGAG | 6888 |
| UCUACCCUCAUCAUGCCCU | 6889 | AGGGCAUGAUGAGGGUAGA | 6890 |
| CUACCCUCAUCAUGCCCUU | 6891 | AAGGGCAUGAUGAGGGUAG | 6892 |
| UACCCUCAUCAUGCCCUUU | 6893 | AAAGGGCAUGAUGAGGGUA | 6894 |
| ACCCUCAUCAUGCCCUUUA | 6895 | UAAAGGGCAUGAUGAGGGU | 6896 |
| CCCUCAUCAUGCCCUUUAC | 6897 | GUAAAGGGCAUGAUGAGGG | 6898 |
| CUCAUCAUGCCCUUUACAC | 6899 | GUGUAAAGGGCAUGAUGAG | 6900 |
| UCAUCAUGCCCUUUACACU | 6901 | AGUGUAAAGGGCAUGAUGA | 6902 |
| CCCUUCUUGACUUUUCUUC | 6903 | GAAGAAAAGUCAAGAAGGG | 6904 |
| CUUCUUGACUUUUCUUCUC | 6905 | GAGAAGAAAAGUCAAGAAG | 6906 |
| GACUUUUCUUCUCAACUAC | 6907 | GUAGUUGAGAAGAAAAGUC | 6908 |
| ACUUUUCUUCUCAACUACC | 6909 | GGUAGUUGAGAAGAAAAGU | 6910 |
| CUUUUCUUCUCAACUACCA | 6911 | UGGUAGUUGAGAAGAAAAG | 6912 |
| UUUUCUUCUCAACUACCAG | 6913 | CUGGUAGUUGAGAAGAAAA | 6914 |
| UAUCUAAUAUAAGCUCGGA | 6915 | UCCGAGCUUAUAUUAGAUA | 6916 |
| AUCUAAUAUAAGCUCGGAG | 6917 | CUCCGAGCUUAUAUUAGAU | 6918 |
| UCUAAUAUAAGCUCGGAGU | 6919 | ACUCCGAGCUUAUAUUAGA | 6920 |
| CUAAUAUAAGCUCGGAGUU | 6921 | AACUCCGAGCUUAUAUUAG | 6922 |
| UAAUAUAAGCUCGGAGUUU | 6923 | AAACUCCGAGCUUAUAUUA | 6924 |
| AAUAUAAGCUCGGAGUUUG | 6925 | CAAACUCCGAGCUUAUAUU | 6926 |
| AUAUAAGCUCGGAGUUUGG | 6927 | CCAAACUCCGAGCUUAUAU | 6928 |
| UAUAAGCUCGGAGUUUGGA | 6929 | UCCAAACUCCGAGCUUAUA | 6930 |
| AUAAGCUCGGAGUUUGGAC | 6931 | GUCCAAACUCCGAGCUUAU | 6932 |
| UAAGCUCGGAGUUUGGACG | 6933 | CGUCCAAACUCCGAGCUUA | 6934 |
| AAGCUCGGAGUUUGGACGG | 6935 | CCGUCCAAACUCCGAGCUU | 6936 |
| AGCUCGGAGUUUGGACGGA | 6937 | UCCGUCCAAACUCCGAGCU | 6938 |
| GCUCGGAGUUUGGACGGAG | 6939 | CUCCGUCCAAACUCCGAGC | 6940 |
| CUCGGAGUUUGGACGGAGG | 6941 | CCUCCGUCCAAACUCCGAG | 6942 |

TABLE 9-continued

| Sense Sequence | SEQ ID NO: | Antisense Sequence | SEQ ID NO: |
|---|---|---|---|
| UCGGAGUUUGGACGGAGGG | 6943 | CCCUCCGUCCAAACUCCGA | 6944 |
| CGGAGUUUGGACGGAGGGU | 6945 | ACCCUCCGUCCAAACUCCG | 6946 |
| UUUGGACGGAGGGUCUGGA | 6947 | UCCAGACCCUCCGUCCAAA | 6948 |
| CCCAGCGACCUUUCCGUGU | 6949 | ACACGGAAAGGUCGCUGGG | 6950 |
| CCAGCGACCUUUCCGUGUC | 6951 | GACACGGAAAGGUCGCUGG | 6952 |
| CAGCGACCUUUCCGUGUCU | 6953 | AGACACGGAAAGGUCGCUG | 6954 |
| AGCGACCUUUCCGUGUCUG | 6955 | CAGACACGGAAAGGUCGCU | 6956 |
| GCGACCUUUCCGUGUCUGU | 6957 | ACAGACACGGAAAGGUCGC | 6958 |
| CGACCUUUCCGUGUCUGUG | 6959 | CACAGACACGGAAAGGUCG | 6960 |
| CUUUCCGUGUCUGUGAUCA | 6961 | UGAUCACAGACACGGAAAG | 6962 |
| UUUCCGUGUCUGUGAUCAC | 6963 | GUGAUCACAGACACGGAAA | 6964 |
| UUCCGUGUCUGUGAUCACA | 6965 | UGUGAUCACAGACACGGAA | 6966 |
| AAGGCCUGACAGCUGCCAC | 6967 | GUGGCAGCUGUCAGGCCUU | 6968 |
| GCCAGGAGCUGCUAGCCAA | 6969 | UUGGCUAGCAGCUCCUGGC | 6970 |
| CCAGGAGCUGCUAGCCAAA | 6971 | UUUGGCUAGCAGCUCCUGG | 6972 |
| GAGCUGCUAGCCAAAGUAA | 6973 | UUACUUUGGCUAGCAGCUC | 6974 |
| AGCUGCUAGCCAAAGUAAG | 6975 | CUUACUUUGGCUAGCAGCU | 6976 |
| GCUGCUAGCCAAAGUAAGU | 6977 | ACUUACUUUGGCUAGCAGC | 6978 |
| CUGCUAGCCAAAGUAAGUA | 6979 | UACUUACUUUGGCUAGCAG | 6980 |
| UGCUAGCCAAAGUAAGUAG | 6981 | CUACUUACUUUGGCUAGCA | 6982 |
| GCUAGCCAAAGUAAGUAGG | 6983 | CCUACUUACUUUGGCUAGC | 6984 |
| UAGCCAAAGUAAGUAGGCC | 6985 | GGCCUACUUACUUUGGCUA | 6986 |
| AGCCAAAGUAAGUAGGCCA | 6987 | UGGCCUACUUACUUUGGCU | 6988 |
| GCCAAAGUAAGUAGGCCAA | 6989 | UUGGCCUACUUACUUUGGC | 6990 |
| CCAAAGUAAGUAGGCCAAG | 6991 | CUUGGCCUACUUACUUUGG | 6992 |
| CAAAGUAAGUAGGCCAAGU | 6993 | ACUUGGCCUACUUACUUUG | 6994 |
| AAAGUAAGUAGGCCAAGUU | 6995 | AACUUGGCCUACUUACUUU | 6996 |
| AAGUAAGUAGGCCAAGUUC | 6997 | GAACUUGGCCUACUUACUU | 6998 |
| AGUAAGUAGGCCAAGUUCC | 6999 | GGAACUUGGCCUACUUACU | 7000 |
| GUAAGUAGGCCAAGUUCCU | 7001 | AGGAACUUGGCCUACUUAC | 7002 |
| UAAGUAGGCCAAGUUCCUC | 7003 | GAGGAACUUGGCCUACUUA | 7004 |
| UAGGCCAAGUUCCUCGGUU | 7005 | AACCGAGGAACUUGGCCUA | 7006 |
| AGGCCAAGUUCCUCGGUUC | 7007 | GAACCGAGGAACUUGGCCU | 7008 |
| GGCCAAGUUCCUCGGUUCC | 7009 | GGAACCGAGGAACUUGGCC | 7010 |
| GCCAAGUUCCUCGGUUCCU | 7011 | AGGAACCGAGGAACUUGGC | 7012 |
| CCAAGUUCCUCGGUUCCUA | 7013 | UAGGAACCGAGGAACUUGG | 7014 |
| CAAGUUCCUCGGUUCCUAU | 7015 | AUAGGAACCGAGGAACUUG | 7016 |
| AAGUUCCUCGGUUCCUAUA | 7017 | UAUAGGAACCGAGGAACUU | 7018 |
| AGUUCCUCGGUUCCUAUAG | 7019 | CUAUAGGAACCGAGGAACU | 7020 |
| GUUCCUCGGUUCCUAUAGC | 7021 | GCUAUAGGAACCGAGGAAC | 7022 |
| UUCCUCGGUUCCUAUAGCA | 7023 | UGCUAUAGGAACCGAGGAA | 7024 |
| UCCUCGGUUCCUAUAGCAG | 7025 | CUGCUAUAGGAACCGAGGA | 7026 |
| CAGUGGCAACUUGUGAUGA | 7027 | UCAUCACAAGUUGCCACUG | 7028 |
| AGUGGCAACUUGUGAUGAU | 7029 | AUCAUCACAAGUUGCCACU | 7030 |
| GUGGCAACUUGUGAUGAUG | 7031 | CAUCAUCACAAGUUGCCAC | 7032 |
| GGCAACUUGUGAUGAUGGA | 7033 | UCCAUCAUCACAAGUUGCC | 7034 |
| ACUUGUGAUGAUGGAGCAG | 7035 | CUGCUCCAUCAUCACAAGU | 7036 |
| CUUGUGAUGAUGGAGCAGA | 7037 | UCUGCUCCAUCAUCACAAG | 7038 |
| GUGAUGAUGGAGCAGAGGG | 7039 | CCCUCUGCUCCAUCAUCAC | 7040 |
| UGAUGAUGGAGCAGAGGGC | 7041 | GCCCUCUGCUCCAUCAUCA | 7042 |
| UGGAGCAGAGGGCUGAAGU | 7043 | ACUUCAGCCCUCUGCUCCA | 7044 |
| GGAGCAGAGGGCUGAAGUC | 7045 | GACUUCAGCCCUCUGCUCC | 7046 |
| GAGCAGAGGGCUGAAGUCA | 7047 | UGACUUCAGCCCUCUGCUC | 7048 |
| CUAAAAGCAGCGGAGUGGG | 7049 | CCCACUCCGCUGCUUUUAG | 7050 |
| UAAAAGCAGCGGAGUGGGC | 7051 | GCCCACUCCGCUGCUUUUA | 7052 |
| AAAAGCAGCGGAGUGGGCC | 7053 | GGCCCACUCCGCUGCUUUU | 7054 |
| AAAGCAGCGGAGUGGGCCU | 7055 | AGGCCCACUCCGCUGCUUU | 7056 |
| AAGCAGCGGAGUGGGCCUA | 7057 | UAGGCCCACUCCGCUGCUU | 7058 |
| AGCAGCGGAGUGGGCCUAA | 7059 | UUAGGCCCACUCCGCUGCU | 7060 |
| GCAGCGGAGUGGGCCUAAU | 7061 | AUUAGGCCCACUCCGCUGC | 7062 |
| CAGCGGAGUGGGCCUAAUG | 7063 | CAUUAGGCCCACUCCGCUG | 7064 |
| AGCGGAGUGGGCCUAAUGA | 7065 | UCAUUAGGCCCACUCCGCU | 7066 |
| GCGGAGUGGGCCUAAUGAG | 7067 | CUCAUUAGGCCCACUCCGC | 7068 |
| AGUGGGCCUAAUGAGCUCU | 7069 | AGAGCUCAUUAGGCCCACU | 7070 |
| GUGGGCCUAAUGAGCUCUG | 7071 | CAGAGCUCAUUAGGCCCAC | 7072 |
| UGGGCCUAAUGAGCUCUGG | 7073 | CCAGAGCUCAUUAGGCCCA | 7074 |
| GGGCCUAAUGAGCUCUGGU | 7075 | ACCAGAGCUCAUUAGGCCC | 7076 |
| GGCCUAAUGAGCUCUGGUC | 7077 | GACCAGAGCUCAUUAGGCC | 7078 |
| GCCUAAUGAGCUCUGGUCA | 7079 | UGACCAGAGCUCAUUAGGC | 7080 |
| CCUAAUGAGCUCUGGUCAA | 7081 | UUGACCAGAGCUCAUUAGG | 7082 |
| CUAAUGAGCUCUGGUCAAU | 7083 | AUUGACCAGAGCUCAUUAG | 7084 |
| UAAUGAGCUCUGGUCAAUU | 7085 | AAUUGACCAGAGCUCAUUA | 7086 |
| AAUGAGCUCUGGUCAAUUU | 7087 | AAAUUGACCAGAGCUCAUU | 7088 |
| AUGAGCUCUGGUCAAUUUG | 7089 | CAAAUUGACCAGAGCUCAU | 7090 |
| UGAGCUCUGGUCAAUUUGU | 7091 | ACAAAUUGACCAGAGCUCA | 7092 |
| CUGGUCAAUUUGUUCAUUU | 7093 | AAAUGAACAAAUUGACCAG | 7094 |

TABLE 9-continued

| Sense Sequence | SEQ ID NO: | Antisense Sequence | SEQ ID NO: |
|---|---|---|---|
| CAAUUUGUUCAUUUUCCAC | 7095 | GUGGAAAAUGAACAAAUUG | 7096 |
| AGUGAGCUUUUCUAUGGGA | 7097 | UCCCAUAGAAAAGCUCACU | 7098 |
| AGCUUUUCUAUGGGAGCAG | 7099 | CUGCUCCCAUAGAAAAGCU | 7100 |
| GAAUUCAGAAGCUAGUAUG | 7101 | CAUACUAGCUUCUGAAUUC | 7102 |
| AUUCAGAAGCUAGUAUGGA | 7103 | UCCAUACUAGCUUCUGAAU | 7104 |
| UUCAGAAGCUAGUAUGGAA | 7105 | UUCCAUACUAGCUUCUGAA | 7106 |
| AAAGGUGAUUUGUGUGACA | 7107 | UGUCACACAAAUCACCUUU | 7108 |
| AUUCUGAUUCUGCCACUUC | 7109 | GAAGUGGCAGAAUCAGAAU | 7110 |
| AUUCUGCCACUUCCUGCCU | 7111 | AGGCAGGAAGUGGCAGAAU | 7112 |
| GCCACUUCCUGCCUGUCAA | 7113 | UUGACAGGCAGGAAGUGGC | 7114 |
| CCACUUCCUGCCUGUCAAA | 7115 | UUUGACAGGCAGGAAGUGG | 7116 |
| AACCUUGGGAAGUUGUUCA | 7117 | UGAACAACUUCCCAAGGUU | 7118 |
| ACCUUGGGAAGUUGUUCAA | 7119 | UUGAACAACUUCCCAAGGU | 7120 |
| CCUUGGGAAGUUGUUCAAC | 7121 | GUUGAACAACUUCCCAAGG | 7122 |
| GGGAAGUUGUUCAACCUAC | 7123 | GUAGGUUGAACAACUUCCC | 7124 |
| GGAAGUUGUUCAACCUACC | 7125 | GGUAGGUUGAACAACUUCC | 7126 |
| GAAGUUGUUCAACCUACCA | 7127 | UGGUAGGUUGAACAACUUC | 7128 |
| AAGUUGUUCAACCUACCAA | 7129 | UUGGUAGGUUGAACAACUU | 7130 |
| AGUUGUUCAACCUACCAAA | 7131 | UUUGGUAGGUUGAACAACU | 7132 |
| GUUGUUCAACCUACCAAAA | 7133 | UUUUGGUAGGUUGAACAAC | 7134 |
| GCAAUAAUAAUACAUCACC | 7135 | GGUGAUGUAUUAUUAUUGC | 7136 |
| AUAAUAAUACAUCACCUCC | 7137 | GGAGGUGAUGUAUUAUUAU | 7138 |
| UAAUACAUCACCUCCUAGG | 7139 | CCUAGGAGGUGAUGUAUUA | 7140 |
| AAUACAUCACCUCCUAGGG | 7141 | CCCUAGGAGGUGAUGUAUU | 7142 |
| AUACAUCACCUCCUAGGGU | 7143 | ACCCUAGGAGGUGAUGUAU | 7144 |
| UACAUCACCUCCUAGGGUU | 7145 | AACCCUAGGAGGUGAUGUA | 7146 |
| ACAUCACCUCCUAGGGUUG | 7147 | CAACCCUAGGAGGUGAUGU | 7148 |
| AAAGGAGUAAGAGGAUAAU | 7149 | AUUAUCCUCUUACUCCUUU | 7150 |
| AAGGAGUAAGAGGAUAAUG | 7151 | CAUUAUCCUCUUACUCCUU | 7152 |
| AGUAAGAGGAUAAUGUAGG | 7153 | CCUACAUUAUCCUCUUACU | 7154 |
| GUAAGAGGAUAAUGUAGGU | 7155 | ACCUACAUUAUCCUCUUAC | 7156 |
| UAAGAGGAUAAUGUAGGUA | 7157 | UACCUACAUUAUCCUCUUA | 7158 |
| AAGAGGAUAAUGUAGGUAA | 7159 | UUACCUACAUUAUCCUCUU | 7160 |
| AGAGGAUAAUGUAGGUAAA | 7161 | UUUACCUACAUUAUCCUCU | 7162 |
| GAGGAUAAUGUAGGUAAAG | 7163 | CUUUACCUACAUUAUCCUC | 7164 |
| GGAUAAUGUAGGUAAAGUC | 7165 | GACUUUACCUACAUUAUCC | 7166 |
| AUAAUGUAGGUAAAGUCCU | 7167 | AGGACUUUACCUACAUUAU | 7168 |
| GUAGGUAAAGUCCUCAUAC | 7169 | GUAUGAGGACUUUACCUAC | 7170 |
| GUAAAGUCCUCAUACCUGG | 7171 | CCAGGUAUGAGGACUUUAC | 7172 |
| UAAAGUCCUCAUACCUGGC | 7173 | GCCAGGUAUGAGGACUUUA | 7174 |
| AAAGUCCUCAUACCUGGCA | 7175 | UGCCAGGUAUGAGGACUUU | 7176 |
| AAGUCCUCAUACCUGGCAC | 7177 | GUGCCAGGUAUGAGGACUU | 7178 |
| AGUCCUCAUACCUGGCACA | 7179 | UGUGCCAGGUAUGAGGACU | 7180 |
| GUCCUCAUACCUGGCACAG | 7181 | CUGUGCCAGGUAUGAGGAC | 7182 |
| UCCUCAUACCUGGCACAGA | 7183 | UCUGUGCCAGGUAUGAGGA | 7184 |
| UCUUGAGGGUGUGGGAAGU | 7185 | ACUUCCCACACCCUCAAGA | 7186 |
| CUUGAGGGUGUGGGAAGUG | 7187 | CACUUCCCACACCCUCAAG | 7188 |
| UUGAGGGUGUGGGAAGUGA | 7189 | UCACUUCCCACACCCUCAA | 7190 |
| UGAGGGUGUGGGAAGUGAG | 7191 | CUCACUUCCCACACCCUCA | 7192 |
| AGGGUGUGGGAAGUGAGGU | 7193 | ACCUCACUUCCCACACCCU | 7194 |
| GGGUGUGGGAAGUGAGGUG | 7195 | CACCUCACUUCCCACACCC | 7196 |
| GGAAGUGAGGUGCAGCAU | 7197 | AUGCUGCACCUCACUUCCC | 7198 |
| GGAAGUGAGGUGCAGCAUU | 7199 | AAUGCUGCACCUCACUUCC | 7200 |
| GAAGUGAGGUGCAGCAUUG | 7201 | CAAUGCUGCACCUCACUUC | 7202 |
| AAGUGAGGUGCAGCAUUGU | 7203 | ACAAUGCUGCACCUCACUU | 7204 |
| AGUGAGGUGCAGCAUUGUA | 7205 | UACAAUGCUGCACCUCACU | 7206 |
| GUGAGGUGCAGCAUUGUAG | 7207 | CUACAAUGCUGCACCUCAC | 7208 |
| UGAGGUGCAGCAUUGUAGA | 7209 | UCUACAAUGCUGCACCUCA | 7210 |
| GAGGUGCAGCAUUGUAGAU | 7211 | AUCUACAAUGCUGCACCUC | 7212 |
| AGGUGCAGCAUUGUAGAUA | 7213 | UAUCUACAAUGCUGCACCU | 7214 |
| GGUGCAGCAUUGUAGAUAA | 7215 | UUAUCUACAAUGCUGCACC | 7216 |
| GUGCAGCAUUGUAGAUAAG | 7217 | CUUAUCUACAAUGCUGCAC | 7218 |
| UGCAGCAUUGUAGAUAAGA | 7219 | UCUUAUCUACAAUGCUGCA | 7220 |
| GCAUUGUAGAUAAGACAGA | 7221 | UCUGUCUUAUCUACAAUGC | 7222 |
| CAUUGUAGAUAAGACAGAA | 7223 | UUCUGUCUUAUCUACAAUG | 7224 |
| AUUGUAGAUAAGACAGAAG | 7225 | CUUCUGUCUUAUCUACAAU | 7226 |
| AUAAGACAGAAGGGUGGAC | 7227 | GUCCACCCUUCUGUCUUAU | 7228 |
| UAAGACAGAAGGGUGGACU | 7229 | AGUCCACCCUUCUGUCUUA | 7230 |
| AACCUGGCUUGCUUUCCAA | 7231 | UUGGAAAGCAAGCCAGGUU | 7232 |
| CCUGGCUUGCUUUCCAAUU | 7233 | AAUUGGAAAGCAAGCCAGG | 7234 |
| ACCAGAAGUGACUUGGAGG | 7235 | CCUCCAAGUCACUUCUGGU | 7236 |
| CCAGAAGUGACUUGGAGGG | 7237 | CCCUCCAAGUCACUUCUGG | 7238 |
| AGAUGCCAAUGACAUGGUA | 7239 | UACCAUGUCAUUGGCAUCU | 7240 |
| GAUGCCAAUGACAUGGUAG | 7241 | CUACCAUGUCAUUGGCAUC | 7242 |
| AUGCCAAUGACAUGGUAGG | 7243 | CCUACCAUGUCAUUGGCAU | 7244 |
| CAAUGACAUGGUAGGAGCA | 7245 | UGCUCCUACCAUGUCAUUG | 7246 |

TABLE 9-continued

| Sense Sequence | SEQ ID NO: | Antisense Sequence | SEQ ID NO: |
|---|---|---|---|
| AAUGACAUGGUAGGAGCAA | 7247 | UUGCUCCUACCAUGUCAUU | 7248 |
| AUGACAUGGUAGGAGCAAA | 7249 | UUUGCUCCUACCAUGUCAU | 7250 |
| UGACAUGGUAGGAGCAAAG | 7251 | CUUUGCUCCUACCAUGUCA | 7252 |
| GACAUGGUAGGAGCAAAGA | 7253 | UCUUUGCUCCUACCAUGUC | 7254 |
| AAAAGGUCAGCCUCUAGCU | 7255 | AGCUAGAGGCUGACCUUUU | 7256 |
| AAAGGUCAGCCUCUAGCUA | 7257 | UAGCUAGAGGCUGACCUUU | 7258 |
| AGGUCAGCCUCUAGCUAGG | 7259 | CCUAGCUAGAGGCUGACCU | 7260 |
| GGUCAGCCUCUAGCUAGGA | 7261 | UCCUAGCUAGAGGCUGACC | 7262 |
| GUCAGCCUCUAGCUAGGAU | 7263 | AUCCUAGCUAGAGGCUGAC | 7264 |
| CAGCCUCUAGCUAGGAUCC | 7265 | GGAUCCUAGCUAGAGGCUG | 7266 |
| AGCCUCUAGCUAGGAUCCC | 7267 | GGGAUCCUAGCUAGAGGCU | 7268 |
| AGAGCUGCAACCUUUAGGA | 7269 | UCCUAAAGGUUGCAGCUCU | 7270 |
| GAGCUGCAACCUUUAGGAG | 7271 | CUCCUAAAGGUUGCAGCUC | 7272 |
| AGCUGCAACCUUUAGGAGG | 7273 | CCUCCUAAAGGUUGCAGCU | 7274 |
| UUUAGGAGGUAUCAAAGUG | 7275 | CACUUUGAUACCUCCUAAA | 7276 |
| UUAGGAGGUAUCAAAGUGC | 7277 | GCACUUUGAUACCUCCUAA | 7278 |
| UAGGAGGUAUCAAAGUGCC | 7279 | GGCACUUUGAUACCUCCUA | 7280 |
| GUCAAAGUGGGACAUCGAC | 7281 | GUCGAUGUCCCACUUUGAC | 7282 |
| CAUCGACCAAUGUCUAGAG | 7283 | CUCUAGACAUUGGUCGAUG | 7284 |
| AUCGACCAAUGUCUAGAGC | 7285 | GCUCUAGACAUUGGUCGAU | 7286 |
| ACCAAUGUCUAGAGCCAAC | 7287 | GUUGGCUCUAGACAUUGGU | 7288 |
| CAAUGUCUAGAGCCAACUG | 7289 | CAGUUGGCUCUAGACAUUG | 7290 |
| AAUGUCUAGAGCCAACUGA | 7291 | UCAGUUGGCUCUAGACAUU | 7292 |
| AUGUCUAGAGCCAACUGAU | 7293 | AUCAGUUGGCUCUAGACAU | 7294 |
| UGUCUAGAGCCAACUGAUG | 7295 | CAUCAGUUGGCUCUAGACA | 7296 |
| GUCUAGAGCCAACUGAUGG | 7297 | CCAUCAGUUGGCUCUAGAC | 7298 |
| UCUAGAGCCAACUGAUGGA | 7299 | UCCAUCAGUUGGCUCUAGA | 7300 |
| CUAGAGCCAACUGAUGGAU | 7301 | AUCCAUCAGUUGGCUCUAG | 7302 |
| UAGAGCCAACUGAUGGAUG | 7303 | CAUCCAUCAGUUGGCUCUA | 7304 |
| AGAGCCAACUGAUGGAUGU | 7305 | ACAUCCAUCAGUUGGCUCU | 7306 |
| GAGCCAACUGAUGGAUGUU | 7307 | AACAUCCAUCAGUUGGCUC | 7308 |
| AACUGAUGGAUGUUGGGCA | 7309 | UGCCCAACAUCCAUCAGUU | 7310 |
| UGGAUGUUGGGCAGCUAAA | 7311 | UUUAGCUGCCCAACAUCCA | 7312 |
| GGAUGUUGGGCAGCUAAAG | 7313 | CUUUAGCUGCCCAACAUCC | 7314 |
| GAUGUUGGGCAGCUAAAGA | 7315 | UCUUUAGCUGCCCAACAUC | 7316 |
| UUGGGCAGCUAAAGAGGGA | 7317 | UCCCUCUUUAGCUGCCCAA | 7318 |
| UGGGCAGCUAAAGAGGGAA | 7319 | UUCCCUCUUUAGCUGCCCA | 7320 |
| GGGCAGCUAAAGAGGGAAG | 7321 | CUUCCCUCUUUAGCUGCCC | 7322 |
| GGCAGCUAAAGAGGGAAGG | 7323 | CCUUCCCUCUUUAGCUGCC | 7324 |
| GCAGCUAAAGAGGGAAGGG | 7325 | CCCUUCCCUCUUUAGCUGC | 7326 |
| GGGCAUGGGAUAAGACCUG | 7327 | CAGGUCUUAUCCCAUGCCC | 7328 |
| GGCAUGGGAUAAGACCUGC | 7329 | GCAGGUCUUAUCCCAUGCC | 7330 |
| GCAUGGGAUAAGACCUGCC | 7331 | GGCAGGUCUUAUCCCAUGC | 7332 |
| CAUGGGAUAAGACCUGCCC | 7333 | GGGCAGGUCUUAUCCCAUG | 7334 |
| AUGGGAUAAGACCUGCCCU | 7335 | AGGGCAGGUCUUAUCCCAU | 7336 |
| UGGGAUAAGACCUGCCCUU | 7337 | AAGGGCAGGUCUUAUCCCA | 7338 |
| GGGAUAAGACCUGCCCUUC | 7339 | GAAGGGCAGGUCUUAUCCC | 7340 |
| GGAUAAGACCUGCCCUUCU | 7341 | AGAAGGGCAGGUCUUAUCC | 7342 |
| AGACCUGCCCUUCUUGCUU | 7343 | AAGCAAGAAGGGCAGGUCU | 7344 |
| GACCUGCCCUUCUUGCUUC | 7345 | GAAGCAAGAAGGGCAGGUC | 7346 |
| CCUGCCCUUCUUGCUUCUU | 7347 | AAGAAGCAAGAAGGGCAGG | 7348 |
| CUGCCCUUCUUGCUUCUUG | 7349 | CAAGAAGCAAGAAGGGCAG | 7350 |
| UGCCCUUCUUGCUUCUUGC | 7351 | GCAAGAAGCAAGAAGGGCA | 7352 |
| UCUUGCUUCUUGCCAUUGG | 7353 | CCAAUGGCAAGAAGCAAGA | 7354 |
| CUUGCUUCUUGCCAUUGGG | 7355 | CCCAAUGGCAAGAAGCAAG | 7356 |
| UUGCUUCUUGCCAUUGGGC | 7357 | GCCCAAUGGCAAGAAGCAA | 7358 |
| CCAUUGGGCAGGCAUUGGA | 7359 | UCCAAUGCCUGCCCAAUGG | 7360 |
| CAUUGGGCAGGCAUUGGAG | 7361 | CUCCAAUGCCUGCCCAAUG | 7362 |
| GACCCUACUGCUGAAUGGA | 7363 | UCCAUUCAGCAGUAGGGUC | 7364 |
| UACUGCUGAAUGGAGUGCU | 7365 | AGCACUCCAUUCAGCAGUA | 7366 |
| ACUGCUGAAUGGAGUGCUA | 7367 | UAGCACUCCAUUCAGCAGU | 7368 |
| CUGCUGAAUGGAGUGCUAA | 7369 | UUAGCACUCCAUUCAGCAG | 7370 |
| UGCUGAAUGGAGUGCUAAC | 7371 | GUUAGCACUCCAUUCAGCA | 7372 |
| GCUGAAUGGAGUGCUAACC | 7373 | GGUUAGCACUCCAUUCAGC | 7374 |
| CUGAAUGGAGUGCUAACCC | 7375 | GGGUUAGCACUCCAUUCAG | 7376 |
| UAACCUGGUGCUAGAGGA | 7377 | UCCUCUAGCACCAGGGUUA | 7378 |
| AACCCUGGUGCUAGAGGAG | 7379 | CUCCUCUAGCACCAGGGUU | 7380 |
| ACCCUGGUGCUAGAGGAGG | 7381 | CCUCCUCUAGCACCAGGGU | 7382 |
| CCCUGGUGCUAGAGGAGGA | 7383 | UCCUCCUCUAGCACCAGGG | 7384 |
| CCUGGUGCUAGAGGAGGAU | 7385 | AUCCUCCUCUAGCACCAGG | 7386 |
| CUGGUGCUAGAGGAGGAUG | 7387 | CAUCCUCCUCUAGCACCAG | 7388 |
| GGUGCUAGAGGAGGAUGGA | 7389 | UCCAUCCUCCUCUAGCACC | 7390 |
| GUGCUAGAGGAGGAUGGAA | 7391 | UUCCAUCCUCCUCUAGCAC | 7392 |
| CUGCAGUGGACAGUGAGGA | 7393 | UCCUCACUGUCCACUGCAG | 7394 |
| UGCAGUGGACAGUGAGGAC | 7395 | GUCCUCACUGUCCACUGCA | 7396 |
| GCAGUGGACAGUGAGGACU | 7397 | AGUCCUCACUGUCCACUGC | 7398 |

TABLE 9-continued

| Sense Sequence | SEQ ID NO: | Antisense Sequence | SEQ ID NO: |
|---|---|---|---|
| CAGUGGACAGUGAGGACUU | 7399 | AAGUCCUCACUGUCCACUG | 7400 |
| AGUGGACAGUGAGGACUUC | 7401 | GAAGUCCUCACUGUCCACU | 7402 |
| GUGGACAGUGAGGACUUCU | 7403 | AGAAGUCCUCACUGUCCAC | 7404 |
| UGGACAGUGAGGACUUCUU | 7405 | AAGAAGUCCUCACUGUCCA | 7406 |
| GGACAGUGAGGACUUCUUC | 7407 | GAAGAAGUCCUCACUGUCC | 7408 |
| AGUGAGGACUUCUUCCAGC | 7409 | GCUGGAAGAAGUCCUCACU | 7410 |
| GUGAGGACUUCUUCCAGCU | 7411 | AGCUGGAAGAAGUCCUCAC | 7412 |
| UGAGGACUUCUUCCAGCUG | 7413 | CAGCUGGAAGAAGUCCUCA | 7414 |
| GAGGACUUCUUCCAGCUGC | 7415 | GCAGCUGGAAGAAGUCCUC | 7416 |
| GUGCCUGAUGGUGUUGCAG | 7417 | CUGCAACACCAUCAGGCAC | 7418 |
| GAUGGUGUUGCAGUCUGGU | 7419 | ACCAGACUGCAACACCAUC | 7420 |
| UGGUGUUGCAGUCUGGUCA | 7421 | UGACCAGACUGCAACACCA | 7422 |
| GGUGUUGCAGUCUGGUCAG | 7423 | CUGACCAGACUGCAACACC | 7424 |
| GUGUUGCAGUCUGGUCAGA | 7425 | UCUGACCAGACUGCAACAC | 7426 |
| UGCAGUCUGGUCAGAGCUG | 7427 | CAGCUCUGACCAGACUGCA | 7428 |
| GCAGUCUGGUCAGAGCUGG | 7429 | CCAGCUCUGACCAGACUGC | 7430 |
| CAGUCUGGUCAGAGCUGGA | 7431 | UCCAGCUCUGACCAGACUG | 7432 |
| AGUCUGGUCAGAGCUGGAG | 7433 | CUCCAGCUCUGACCAGACU | 7434 |
| GUCUGGUCAGAGCUGGAGC | 7435 | GCUCCAGCUCUGACCAGAC | 7436 |
| UCUGGUCAGAGCUGGAGCC | 7437 | GGCUCCAGCUCUGACCAGA | 7438 |
| UGGUCAGAGCUGGAGCCCU | 7439 | AGGGCUCCAGCUCUGACCA | 7440 |
| GGUCAGAGCUGGAGCCCUA | 7441 | UAGGGCUCCAGCUCUGACC | 7442 |
| GUCAGAGCUGGAGCCCUAC | 7443 | GUAGGGCUCCAGCUCUGAC | 7444 |
| CAAGGGUAAGAGGCCUAUA | 7445 | UAUAGGCCUCUUACCCUUG | 7446 |
| AAGGGUAAGAGGCCUAUAC | 7447 | GUAUAGGCCUCUUACCCUU | 7448 |
| AGGGUAAGAGGCCUAUACU | 7449 | AGUAUAGGCCUCUUACCCU | 7450 |
| GGGUAAGAGGCCUAUACUG | 7451 | CAGUAUAGGCCUCUUACCC | 7452 |
| GGUAAGAGGCCUAUACUGG | 7453 | CCAGUAUAGGCCUCUUACC | 7454 |
| GUAAGAGGCCUAUACUGGG | 7455 | CCCAGUAUAGGCCUCUUAC | 7456 |
| GGGCUGCUUCCAAUGCCUG | 7457 | CAGGCAUUGGAAGCAGCCC | 7458 |
| GGCUGCUUCCAAUGCCUGU | 7459 | ACAGGCAUUGGAAGCAGCC | 7460 |
| GCUGCUUCCAAUGCCUGUC | 7461 | GACAGGCAUUGGAAGCAGC | 7462 |
| CUGCUUCCAAUGCCUGUCC | 7463 | GGACAGGCAUUGGAAGCAG | 7464 |
| UGCUUCCAAUGCCUGUCCU | 7465 | AGGACAGGCAUUGGAAGCA | 7466 |
| GCUUCCAAUGCCUGUCCUU | 7467 | AAGGACAGGCAUUGGAAGC | 7468 |
| CUUCCAAUGCCUGUCCUUU | 7469 | AAAGGACAGGCAUUGGAAG | 7470 |
| UUCCAAUGCCUGUCCUUUA | 7471 | UAAAGGACAGGCAUUGGAA | 7472 |
| UCCAAUGCCUGUCCUUUAG | 7473 | CUAAAGGACAGGCAUUGGA | 7474 |
| CAAUGCCUGUCCUUUAGAG | 7475 | CUCUAAAGGACAGGCAUUG | 7476 |
| AAUGCCUGUCCUUUAGAGC | 7477 | GCUCUAAAGGACAGGCAUU | 7478 |
| AUGCCUGUCCUUUAGAGCU | 7479 | AGCUCUAAAGGACAGGCAU | 7480 |
| CUUCCUCUCUAGCUUAACC | 7481 | GGUUAAGCUAGAGAGGAAG | 7482 |
| UUCCUCUCUAGCUUAACCC | 7483 | GGGUUAAGCUAGAGAGGAA | 7484 |
| UCUCUAGCUUAACCCUGAU | 7485 | AUCAGGGUUAAGCUAGAGA | 7486 |
| UAGCUUAACCCUGAUCCUG | 7487 | CAGGAUCAGGGUUAAGCUA | 7488 |
| GACCAGGUGCAGGAGGAGU | 7489 | ACUCCUCCUGCACCUGGUC | 7490 |
| ACCAGGUGCAGGAGGAGUU | 7491 | AACUCCUCCUGCACCUGGU | 7492 |
| CCAGGUGCAGGAGGAGUUG | 7493 | CAACUCCUCCUGCACCUGG | 7494 |
| CAGGUGCAGGAGGAGUUGU | 7495 | ACAACUCCUCCUGCACCUG | 7496 |
| AGGUGCAGGAGGAGUUGUG | 7497 | CACAACUCCUCCUGCACCU | 7498 |
| UGCAGGAGGAGUUGUGGAA | 7499 | UUCCACAACUCCUCCUGCA | 7500 |
| GCAGGAGGAGUUGUGGAAU | 7501 | AUUCCACAACUCCUCCUGC | 7502 |
| AGGAGGAGUUGUGGAAUUG | 7503 | CAAUUCCACAACUCCUCCU | 7504 |
| GGAGGAGUUGUGGAAUUGU | 7505 | ACAAUUCCACAACUCCUCC | 7506 |
| GAGGAGUUGUGGAAUUGUC | 7507 | GACAAUUCCACAACUCCUC | 7508 |
| AGGAGUUGUGGAAUUGUCA | 7509 | UGACAAUUCCACAACUCCU | 7510 |
| GGAGUUGUGGAAUUGUCAA | 7511 | UUGACAAUUCCACAACUCC | 7512 |
| GAGUUGUGGAAUUGUCAAG | 7513 | CUUGACAAUUCCACAACUC | 7514 |
| AGUUGUGGAAUUGUCAAGG | 7515 | CCUUGACAAUUCCACAACU | 7516 |
| GUUGUGGAAUUGUCAAGGA | 7517 | UCCUUGACAAUUCCACAAC | 7518 |
| UGGAAUUGUCAAGGAUGUC | 7519 | GACAUCCUUGACAAUUCCA | 7520 |
| GGAAUUGUCAAGGAUGUCA | 7521 | UGACAUCCUUGACAAUUCC | 7522 |
| AGUCCAAGCGAGGGAGGGU | 7523 | ACCCUCCCUCGCUUGGACU | 7524 |
| CAAGCGAGGGAGGGUCUGA | 7525 | UCAGACCCUCCCUCGCUUG | 7526 |
| AAGCGAGGGAGGGUCUGAC | 7527 | GUCAGACCCUCCCUCGCUU | 7528 |
| CUGACCCAGUGCUGAUGGA | 7529 | UCCAUCAGCACUGGGUCAG | 7530 |
| AGAUUAGUGGUGGGUGUCU | 7531 | AGACACCCACCACUAAUCU | 7532 |
| AUUAGUGGUGGGUGUCUGG | 7533 | CCAGACACCCACCACUAAU | 7534 |
| UUAGUGGUGGGUGUCUGGU | 7535 | ACCAGACACCCACCACUAA | 7536 |
| UAGUGGUGGGUGUCUGGUA | 7537 | UACCAGACACCCACCACUA | 7538 |
| AGUGGUGGGUGUCUGGUAU | 7539 | AUACCAGACACCCACCACU | 7540 |
| GUGGUGGGUGUCUGGUAUG | 7541 | CAUACCAGACACCCACCAC | 7542 |
| UGGUGGGUGUCUGGUAUGA | 7543 | UCAUACCAGACACCCACCA | 7544 |
| GGUGGGUGUCUGGUAUGAG | 7545 | CUCAUACCAGACACCCACC | 7546 |
| GUGGGUGUCUGGUAUGAGG | 7547 | CCUCAUACCAGACACCCAC | 7548 |
| UGGGUGUCUGGUAUGAGGA | 7549 | UCCUCAUACCAGACACCCA | 7550 |

TABLE 9-continued

| Sense Sequence | SEQ ID NO: | Antisense Sequence | SEQ ID NO: |
|---|---|---|---|
| GGGUGUCUGGUAUGAGGAU | 7551 | AUCCUCAUACCAGACACCC | 7552 |
| GGUGUCUGGUAUGAGGAUC | 7553 | GAUCCUCAUACCAGACACC | 7554 |
| GUGUCUGGUAUGAGGAUCU | 7555 | AGAUCCUCAUACCAGACAC | 7556 |
| UGUCUGGUAUGAGGAUCUA | 7557 | UAGAUCCUCAUACCAGACA | 7558 |
| CAAGGGUGUCCUACAGAGU | 7559 | ACUCUGUAGGACACCCUUG | 7560 |
| AAGGGUGUCCUACAGAGUG | 7561 | CACUCUGUAGGACACCCUU | 7562 |
| AGGGUGUCCUACAGAGUGG | 7563 | CCACUCUGUAGGACACCCU | 7564 |
| GGGUGUCCUACAGAGUGGA | 7565 | UCCACUCUGUAGGACACCC | 7566 |
| GGUGUCCUACAGAGUGGAG | 7567 | CUCCACUCUGUAGGACACC | 7568 |
| UCCUACAGAGUGGAGUGCU | 7569 | AGCACUCCACUCUGUAGGA | 7570 |
| AGUGGAGUGCUGUCAUAUG | 7571 | CAUAUGACAGCACUCCACU | 7572 |
| GUGGAGUGCUGUCAUAUGG | 7573 | CCAUAUGACAGCACUCCAC | 7574 |
| UGGAGUGCUGUCAUAUGGC | 7575 | GCCAUAUGACAGCACUCCA | 7576 |
| GGAGUGCUGUCAUAUGGCC | 7577 | GGCCAUAUGACAGCACUCC | 7578 |
| GAGUGCUGUCAUAUGGCCU | 7579 | AGGCCAUAUGACAGCACUC | 7580 |
| AGUGCUGUCAUAUGGCCUG | 7581 | CAGGCCAUAUGACAGCACU | 7582 |
| GUGCUGUCAUAUGGCCUGG | 7583 | CCAGGCCAUAUGACAGCAC | 7584 |
| UGCUGUCAUAUGGCCUGGG | 7585 | CCCAGGCCAUAUGACAGCA | 7586 |
| GCUGUCAUAUGGCCUGGGA | 7587 | UCCCAGGCCAUAUGACAGC | 7588 |
| CUGUCAUAUGGCCUGGGAC | 7589 | GUCCCAGGCCAUAUGACAG | 7590 |
| UGUCAUAUGGCCUGGGACG | 7591 | CGUCCCAGGCCAUAUGACA | 7592 |
| GUCAUAUGGCCUGGGACGG | 7593 | CCGUCCCAGGCCAUAUGAC | 7594 |
| AGAGGCCCAAGCACAGCAA | 7595 | UUGCUGUGCUUGGGCCUCU | 7596 |
| GAGGCCCAAGCACAGCAAG | 7597 | CUUGCUGUGCUUGGGCCUC | 7598 |
| AGGCCCAAGCACAGCAAGG | 7599 | CCUUGCUGUGCUUGGGCCU | 7600 |
| GGCCCAAGCACAGCAAGGA | 7601 | UCCUUGCUGUGCUUGGGCC | 7602 |
| CCAAGCACAGCAAGGACAU | 7603 | AUGUCCUUGCUGUGCUUGG | 7604 |
| GCCCGAUUCACCUUUGACG | 7605 | CGUCAAAGGUGAAUCGGGC | 7606 |
| GAUUCACCUUUGACGUGUA | 7607 | UACACGUCAAAGGUGAAUC | 7608 |
| AUUCACCUUUGACGUGUAC | 7609 | GUACACGUCAAAGGUGAAU | 7610 |
| UUGGCAGCCUGAAUGUCAA | 7611 | UUGACAUUCAGGCUGCCAA | 7612 |
| UGGCAGCCUGAAUGUCAAA | 7613 | UUUGACAUUCAGGCUGCCA | 7614 |
| GGCAGCCUGAAUGUCAAAG | 7615 | CUUUGACAUUCAGGCUGCC | 7616 |
| GCAGCCUGAAUGUCAAAGC | 7617 | GCUUUGACAUUCAGGCUGC | 7618 |
| CAGCCUGAAUGUCAAAGCC | 7619 | GGCUUUGACAUUCAGGCUG | 7620 |
| AGCCUGAAUGUCAAAGCCA | 7621 | UGGCUUUGACAUUCAGGCU | 7622 |
| GCCUGAAUGUCAAAGCCAC | 7623 | GUGGCUUUGACAUUCAGGC | 7624 |
| GUCAAAGCCACAUUCUACG | 7625 | CGUAGAAUGUGGCUUUGAC | 7626 |
| UCAAAGCCACAUUCUACGG | 7627 | CCGUAGAAUGUGGCUUUGA | 7628 |
| CAAAGCCACAUUCUACGGG | 7629 | CCCGUAGAAUGUGGCUUUG | 7630 |
| AAAGCCACAUUCUACGGGC | 7631 | GCCCGUAGAAUGUGGCUUU | 7632 |
| GCCACAUUCUACGGGCUCU | 7633 | AGAGCCCGUAGAAUGUGGC | 7634 |
| CCACAUUCUACGGGCUCUA | 7635 | UAGAGCCCGUAGAAUGUGG | 7636 |
| CACAUUCUACGGGCUCUAC | 7637 | GUAGAGCCCGUAGAAUGUG | 7638 |
| UUCUACGGGCUCUACUCUA | 7639 | UAGAGUAGAGCCCGUAGAA | 7640 |
| UCUACGGGCUCUACUCUAU | 7641 | AUAGAGUAGAGCCCGUAGA | 7642 |
| CUACGGGCUCUACUCUAUG | 7643 | CAUAGAGUAGAGCCCGUAG | 7644 |
| CUCUAUGAGUUGUGACUUU | 7645 | AAAGUCACAACUCAUAGAG | 7646 |
| UCUAUGAGUUGUGACUUUC | 7647 | GAAAGUCACAACUCAUAGA | 7648 |
| UGAGUUGUGACUUUCAAGG | 7649 | CCUUGAAAGUCACAACUCA | 7650 |
| GAGUUGUGACUUUCAAGGA | 7651 | UCCUUGAAAGUCACAACUC | 7652 |
| AGUUGUGACUUUCAAGGAC | 7653 | GUCCUUGAAAGUCACAACU | 7654 |
| GUUGUGACUUUCAAGGACU | 7655 | AGUCCUUGAAAGUCACAAC | 7656 |
| GACUUUCAAGGACUUGGCC | 7657 | GGCCAAGUCCUUGAAAGUC | 7658 |
| UUUCAAGGACUUGGCCCAA | 7659 | UUGGGCCAAGUCCUUGAAA | 7660 |
| UUCAAGGACUUGGCCCAAA | 7661 | UUUGGGCCAAGUCCUUGAA | 7662 |
| CCCUACAGUUGGAUAGUCC | 7663 | GGACUAUCCAACUGUAGGG | 7664 |
| CCUACAGUUGGAUAGUCCC | 7665 | GGGACUAUCCAACUGUAGG | 7666 |
| AUUCGUCCUCUUGCACCCA | 7667 | UGGGUGCAAGAGGACGAAU | 7668 |
| UUCGUCCUCUUGCACCCAC | 7669 | GUGGGUGCAAGAGGACGAA | 7670 |
| UCCUCUUGCACCCACCUAC | 7671 | GUAGGUGGGUGCAAGAGGA | 7672 |
| CCUCUUGCACCCACCUACC | 7673 | GGUAGGUGGGUGCAAGAGG | 7674 |
| CUCUUGCACCCACCUACCC | 7675 | GGGUAGGUGGGUGCAAGAG | 7676 |
| CUAGUUAGCUCUUGCUUGU | 7677 | ACAAGCAAGAGCUAACUAG | 7678 |
| UAGUUAGCUCUUGCUUGUG | 7679 | CACAAGCAAGAGCUAACUA | 7680 |
| AGUUAGCUCUUGCUUGUGG | 7681 | CCACAAGCAAGAGCUAACU | 7682 |
| UUAGCUCUUGCUUGUGGAA | 7683 | UUCCACAAGCAAGAGCUAA | 7684 |
| UCCUCAUCUCCCAGCUUGA | 7685 | UCAAGCUGGGAGAUGAGGA | 7686 |
| AUCUCCCAGCUUGAUGGCU | 7687 | AGCCAUCAAGCUGGGAGAU | 7688 |
| UCUCCCAGCUUGAUGGCUU | 7689 | AAGCCAUCAAGCUGGGAGA | 7690 |
| CUCCCAGCUUGAUGGCUUC | 7691 | GAAGCCAUCAAGCUGGGAG | 7692 |
| UCCCAGCUUGAUGGCUUCC | 7693 | GGAAGCCAUCAAGCUGGGA | 7694 |
| CCCAGCUUGAUGGCUUCCU | 7695 | AGGAAGCCAUCAAGCUGGG | 7696 |
| CCAGCUUGAUGGCUUCCUC | 7697 | GAGGAAGCCAUCAAGCUGG | 7698 |
| UGAUGGCUUCCUCCCAAGU | 7699 | ACUUGGGAGGAAGCCAUCA | 7700 |
| GAUGGCUUCCUCCCAAGUU | 7701 | AACUUGGGAGGAAGCCAUC | 7702 |

TABLE 9-continued

| Sense Sequence | SEQ ID NO: | Antisense Sequence | SEQ ID NO: |
|---|---|---|---|
| GGCUUCCUCCCAAGUUUUC | 7703 | GAAAACUUGGGAGGAAGCC | 7704 |
| CCUCCCAAGUUUUCCAAAU | 7705 | AUUUGGAAAACUUGGGAGG | 7706 |
| CCCAAGUUUUCCAAAUCAU | 7707 | AUGAUUUGGAAAACUUGGG | 7708 |
| CCAAGUUUUCCAAAUCAUC | 7709 | GAUGAUUUGGAAAACUUGG | 7710 |
| CAAGUUUUCCAAAUCAUCU | 7711 | AGAUGAUUUGGAAAACUUG | 7712 |
| AAGUUUUCCAAAUCAUCUG | 7713 | CAGAUGAUUUGGAAAACUU | 7714 |
| GUUUUCCAAAUCAUCUGAU | 7715 | AUCAGAUGAUUUGGAAAAC | 7716 |
| AUCUGAUUCCUCUUGUCU | 7717 | AGACAAGAGGAAAUCAGAU | 7718 |
| UCUGAUUCCUCUUGUCUC | 7719 | GAGACAAGAGGAAAUCAGA | 7720 |
| CUGAUUUCCUCUUGUCUCU | 7721 | AGAGACAAGAGGAAAUCAG | 7722 |
| CUCUUGUCUCUGCCAUUCA | 7723 | UGAAUGGCAGAGACAAGAG | 7724 |
| GUUGGACCUCCACACUGCU | 7725 | AGCAGUGUGGAGGUCCAAC | 7726 |
| CCACACUGCUGCAAGGCCU | 7727 | AGGCCUUGCAGCAGUGUGG | 7728 |
| CACACUGCUGCAAGGCCUG | 7729 | CAGGCCUUGCAGCAGUGUG | 7730 |
| ACACUGCUGCAAGGCCUGG | 7731 | CCAGGCCUUGCAGCAGUGU | 7732 |
| UGCAAGGCCUGGGCCAUAU | 7733 | AUAUGGCCCAGGCCUUGCA | 7734 |
| GCAAGGCCUGGGCCAUAUG | 7735 | CAUAUGGCCCAGGCCUUGC | 7736 |
| CAAGGCCUGGGCCAUAUGU | 7737 | ACAUAUGGCCCAGGCCUUG | 7738 |
| AAGGCCUGGGCCAUAUGUU | 7739 | AACAUAUGGCCCAGGCCUU | 7740 |
| AGGCCUGGGCCAUAUGUUG | 7741 | CAACAUAUGGCCCAGGCCU | 7742 |
| GGCCUGGGCCAUAUGUUGC | 7743 | GCAACAUAUGGCCCAGGCC | 7744 |
| GCCUGGGCCAUAUGUUGCU | 7745 | AGCAACAUAUGGCCCAGGC | 7746 |
| CCUGGGCCAUAUGUUGCUG | 7747 | CAGCAACAUAUGGCCCAGG | 7748 |
| GGCCAUAUGUUGCUGGGAA | 7749 | UUCCCAGCAACAUAUGGCC | 7750 |
| CCAUAUGUUGCUGGGAAUU | 7751 | AAUUCCCAGCAACAUAUGG | 7752 |
| GGAAUUCCUCCACCCUUC | 7753 | GAAGGGUGGAGGAAUUCC | 7754 |
| GAAUUCCUCCACCCUUCG | 7755 | CGAAGGGUGGAGGAAUUC | 7756 |
| AAUUCCUCCACCCUUCGU | 7757 | ACGAAGGGUGGAGGAAUU | 7758 |
| AUUCCUCCACCCUUCGUC | 7759 | GACGAAGGGUGGAGGAAU | 7760 |
| UUCCUCCACCCUUCGUCA | 7761 | UGACGAAGGGUGGAGGAA | 7762 |
| UCCUCCACCCUUCGUCAU | 7763 | AUGACGAAGGGUGGAGGAA | 7764 |
| CCUCCACCCUUCGUCAUG | 7765 | CAUGACGAAGGGUGGAGGA | 7766 |
| CUCCACCCUUCGUCAUGC | 7767 | GCAUGACGAAGGGUGGAGG | 7768 |
| UCCACCCUUCGUCAUGCA | 7769 | UGCAUGACGAAGGGUGGAG | 7770 |
| CCUUCGUCAUGCAGUGGAG | 7771 | CUCCACUGCAUGACGAAGG | 7772 |
| CUUCGUCAUGCAGUGGAGG | 7773 | CCUCCACUGCAUGACGAAG | 7774 |
| UUCGUCAUGCAGUGGAGGG | 7775 | CCCUCCACUGCAUGACGAA | 7776 |
| CGCCUCCAUUCCUACUAAG | 7777 | CUUAGUAGGAAUGGAGGCG | 7778 |
| GCCUCCAUUCCUACUAAGG | 7779 | CCUUAGUAGGAAUGGAGGC | 7780 |
| CCUCCAUUCCUACUAAGGG | 7781 | CCCUUAGUAGGAAUGGAGG | 7782 |
| CAGAAUCAUUCCAACCGAC | 7783 | GUCGGUUGGAAUGAUUCUG | 7784 |
| AGAAUCAUUCCAACCGACC | 7785 | GGUCGGUUGGAAUGAUUCU | 7786 |
| GAAUCAUUCCAACCGACCC | 7787 | GGGUCGGUUGGAAUGAUUC | 7788 |
| AAUCAUUCCAACCGACCCA | 7789 | UGGGUCGGUUGGAAUGAUU | 7790 |
| AUCAUUCCAACCGACCCAC | 7791 | GUGGGUCGGUUGGAAUGAU | 7792 |
| UCAUUCCAACCGACCCACU | 7793 | AGUGGGUCGGUUGGAAUGA | 7794 |
| UCCAACCGACCCACUGCAA | 7795 | UUGCAGUGGGUCGGUUGGA | 7796 |
| CCAACCGACCCACUGCAAA | 7797 | UUUGCAGUGGGUCGGUUGG | 7798 |
| CAACCGACCCACUGCAAAG | 7799 | CUUUGCAGUGGGUCGGUUG | 7800 |
| AACCGACCCACUGCAAAGA | 7801 | UCUUUGCAGUGGGUCGGUU | 7802 |
| ACCGACCCACUGCAAAGAC | 7803 | GUCUUUGCAGUGGGUCGGU | 7804 |
| CCGACCCACUGCAAAGACU | 7805 | AGUCUUUGCAGUGGGUCGG | 7806 |
| CGACCCACUGCAAAGACUA | 7807 | UAGUCUUUGCAGUGGGUCG | 7808 |
| GACCCACUGCAAAGACUAU | 7809 | AUAGUCUUUGCAGUGGGUC | 7810 |
| ACCCACUGCAAAGACUAUG | 7811 | CAUAGUCUUUGCAGUGGGU | 7812 |
| ACUGCAAAGACUAUGACAG | 7813 | CUGUCAUAGUCUUUGCAGU | 7814 |
| CUGCAAAGACUAUGACAGC | 7815 | GCUGUCAUAGUCUUUGCAG | 7816 |
| UGCAAAGACUAUGACAGCA | 7817 | UGCUGUCAUAGUCUUUGCA | 7818 |
| GCAAAGACUAUGACAGCAU | 7819 | AUGCUGUCAUAGUCUUUGC | 7820 |
| AAAGACUAUGACAGCAUCA | 7821 | UGAUGCUGUCAUAGUCUUU | 7822 |
| AAGACUAUGACAGCAUCAA | 7823 | UUGAUGCUGUCAUAGUCUU | 7824 |
| AGACUAUGACAGCAUCAAA | 7825 | UUUGAUGCUGUCAUAGUCU | 7826 |
| GACUAUGACAGCAUCAAAU | 7827 | AUUUGAUGCUGUCAUAGUC | 7828 |
| CUAUGACAGCAUCAAAUUU | 7829 | AAAUUUGAUGCUGUCAUAG | 7830 |
| UAUGACAGCAUCAAAUUUC | 7831 | GAAAUUUGAUGCUGUCAUA | 7832 |
| GCAUCAAAUUUCAGGACCU | 7833 | AGGUCCUGAAAUUUGAUGC | 7834 |
| AUCAAAUUUCAGGACCUGC | 7835 | GCAGGUCCUGAAAUUUGAU | 7836 |
| UCAAAUUUCAGGACCUGCA | 7837 | UGCAGGUCCUGAAAUUUGA | 7838 |
| UUCAGGACCUGCAGACAGU | 7839 | ACUGUCUGCAGGUCCUGAA | 7840 |
| UCAGGACCUGCAGACAGUA | 7841 | UACUGUCUGCAGGUCCUGA | 7842 |
| CAGGACCUGCAGACAGUAC | 7843 | GUACUGUCUGCAGGUCCUG | 7844 |
| AGGACCUGCAGACAGUACA | 7845 | UGUACUGUCUGCAGGUCCU | 7846 |
| GGACCUGCAGACAGUACAG | 7847 | CUGUACUGUCUGCAGGUCC | 7848 |
| CUGCAGACAGUACAGGCUA | 7849 | UAGCCUGUACUGUCUGCAG | 7850 |
| GACAGUACAGGCUAGAUAA | 7851 | UUAUCUAGCCUGUACUGUC | 7852 |
| ACAGUACAGGCUAGAUAAC | 7853 | GUUAUCUAGCCUGUACUGU | 7854 |

TABLE 9-continued

| Sense Sequence | SEQ ID NO: | Antisense Sequence | SEQ ID NO: |
|---|---|---|---|
| CAGUACAGGCUAGAUAACC | 7855 | GGUUAUCUAGCCUGUACUG | 7856 |
| AGUACAGGCUAGAUAACCC | 7857 | GGGUUAUCUAGCCUGUACU | 7858 |
| GUACAGGCUAGAUAACCCA | 7859 | UGGGUUAUCUAGCCUGUAC | 7860 |
| UACAGGCUAGAUAACCCAC | 7861 | GUGGGUUAUCUAGCCUGUA | 7862 |
| GCUAGAUAACCCACCCAAU | 7863 | AUUGGGUGGGUUAUCUAGC | 7864 |
| CUAGAUAACCCACCCAAUU | 7865 | AAUUGGGUGGGUUAUCUAG | 7866 |
| AGAUAACCCACCCAAUUUC | 7867 | GAAAUUGGGUGGGUUAUCU | 7868 |
| GAUAACCCACCCAAUUUCC | 7869 | GGAAAUUGGGUGGGUUAUC | 7870 |
| AACCUUUCAGCAUAACGCC | 7871 | GGCGUUAUGCUGAAAGGUU | 7872 |
| ACCUUUCAGCAUAACGCCU | 7873 | AGGCGUUAUGCUGAAAGGU | 7874 |
| CCUUUCAGCAUAACGCCUC | 7875 | GAGGCGUUAUGCUGAAAGG | 7876 |
| CUUUCAGCAUAACGCCUCA | 7877 | UGAGGCGUUAUGCUGAAAG | 7878 |
| UUUCAGCAUAACGCCUCAC | 7879 | GUGAGGCGUUAUGCUGAAA | 7880 |
| UUCAGCAUAACGCCUCACA | 7881 | UGUGAGGCGUUAUGCUGAA | 7882 |
| UCAGCAUAACGCCUCACAU | 7883 | AUGUGAGGCGUUAUGCUGA | 7884 |
| CAGCAUAACGCCUCACAUC | 7885 | GAUGUGAGGCGUUAUGCUG | 7886 |
| AGCAUAACGCCUCACAUCC | 7887 | GGAUGUGAGGCGUUAUGCU | 7888 |
| GCAUAACGCCUCACAUCCC | 7889 | GGGAUGUGAGGCGUUAUGC | 7890 |
| AACGCCUCACAUCCCAAGU | 7891 | ACUUGGGAUGUGAGGCGUU | 7892 |
| ACGCCUCACAUCCCAAGUC | 7893 | GACUUGGGAUGUGAGGCGU | 7894 |
| CGCCUCACAUCCCAAGUCU | 7895 | AGACUUGGGAUGUGAGGCG | 7896 |
| UCACAUCCCAAGUCUAUAC | 7897 | GUAUAGACUUGGGAUGUGA | 7898 |
| CACAUCCCAAGUCUAUACC | 7899 | GGUAUAGACUUGGGAUGUG | 7900 |
| ACAUCCCAAGUCUAUACCC | 7901 | GGGUAUAGACUUGGGAUGU | 7902 |
| CAUCCCAAGUCUAUACCCU | 7903 | AGGGUAUAGACUUGGGAUG | 7904 |
| AAUGCUGUUCUUUCCUAGC | 7905 | GCUAGGAAAGAACAGCAUU | 7906 |
| AUGCUGUUCUUUCCUAGCC | 7907 | GGCUAGGAAAGAACAGCAU | 7908 |
| CUGUUCUUUCCUAGCCACC | 7909 | GGUGGCUAGGAAAGAACAG | 7910 |
| UGUUCUUUCCUAGCCACCU | 7911 | AGGUGGCUAGGAAAGAACA | 7912 |
| GCCAAGAUCAAGAUGUCCC | 7913 | GGGACAUCUUGAUCUUGGC | 7914 |
| UCUUGAUCCCAGCCUGACU | 7915 | AGUCAGGCUGGGAUCAAGA | 7916 |
| CUUGAUCCCAGCCUGACUG | 7917 | CAGUCAGGCUGGGAUCAAG | 7918 |
| UUGAUCCCAGCCUGACUGC | 7919 | GCAGUCAGGCUGGGAUCAA | 7920 |
| UGAUCCCAGCCUGACUGCU | 7921 | AGCAGUCAGGCUGGGAUCA | 7922 |
| CUGACUGCUGCUACAUCUA | 7923 | UAGAUGUAGCAGCAGUCAG | 7924 |
| GACUGCUGCUACAUCUAAU | 7925 | AUUAGAUGUAGCAGCAGUC | 7926 |
| ACUGCUGCUACAUCUAAUC | 7927 | GAUUAGAUGUAGCAGCAGU | 7928 |
| CUGCUGCUACAUCUAAUCC | 7929 | GGAUUAGAUGUAGCAGCAG | 7930 |
| UGCUGCUACAUCUAAUCCC | 7931 | GGGAUUAGAUGUAGCAGCA | 7932 |
| CCUACCAAUGCCUCCUGUC | 7933 | GACAGGAGGCAUUGGUAGG | 7934 |
| CUACCAAUGCCUCCUGUCC | 7935 | GGACAGGAGGCAUUGGUAG | 7936 |
| CCAAUGCCUCCUGUCCCUA | 7937 | UAGGGACAGGAGGCAUUGG | 7938 |
| CAAUGCCUCCUGUCCCUAA | 7939 | UUAGGGACAGGAGGCAUUG | 7940 |
| AAUGCCUCCUGUCCCUAAA | 7941 | UUUAGGGACAGGAGGCAUU | 7942 |
| CCCAGCAUACUGAUGACAG | 7943 | CUGUCAUCAGUAUGCUGGG | 7944 |
| CCAGCAUACUGAUGACAGC | 7945 | GCUGUCAUCAGUAUGCUGG | 7946 |
| CAUACUGAUGACAGCCCUC | 7947 | GAGGGCUGUCAUCAGUAUG | 7948 |
| AUACUGAUGACAGCCCUCU | 7949 | AGAGGGCUGUCAUCAGUAU | 7950 |
| UACUGAUGACAGCCCUCUC | 7951 | GAGAGGGCUGUCAUCAGUA | 7952 |
| ACUGAUGACAGCCCUCUCU | 7953 | AGAGAGGGCUGUCAUCAGU | 7954 |
| CUGAUGACAGCCCUCUCUG | 7955 | CAGAGAGGGCUGUCAUCAG | 7956 |
| UGAUGACAGCCCUCUCUGA | 7957 | UCAGAGAGGGCUGUCAUCA | 7958 |
| GAUGACAGCCCUCUCUGAC | 7959 | GUCAGAGAGGGCUGUCAUC | 7960 |
| AUGACAGCCCUCUCUGACU | 7961 | AGUCAGAGAGGGCUGUCAU | 7962 |
| UGACAGCCCUCUCUGACUU | 7963 | AAGUCAGAGAGGGCUGUCA | 7964 |
| GACAGCCCUCUCUGACUUU | 7965 | AAAGUCAGAGAGGGCUGUC | 7966 |
| ACAGCCCUCUCUGACUUUA | 7967 | UAAAGUCAGAGAGGGCUGU | 7968 |
| CAGCCCUCUCUGACUUUAC | 7969 | GUAAAGUCAGAGAGGGCUG | 7970 |
| AGCCCUCUCUGACUUUACC | 7971 | GGUAAAGUCAGAGAGGGCU | 7972 |
| GCCCUCUCUGACUUUACCU | 7973 | AGGUAAAGUCAGAGAGGGC | 7974 |
| CCCUCUCUGACUUUACCUU | 7975 | AAGGUAAAGUCAGAGAGGG | 7976 |
| CCUCUCUGACUUUACCUUG | 7977 | CAAGGUAAAGUCAGAGAGG | 7978 |
| CUCUCUGACUUUACCUUGA | 7979 | UCAAGGUAAAGUCAGAGAG | 7980 |
| AGAUCUGUCUUCAUACCCU | 7981 | AGGGUAUGAAGACAGAUCU | 7982 |
| GAUCUGUCUUCAUACCCUU | 7983 | AAGGGUAUGAAGACAGAUC | 7984 |
| CUGUCUUCAUACCCUUCCC | 7985 | GGGAAGGGUAUGAAGACAG | 7986 |

In some embodiments, the siRNA molecules targeted to Transcript C comprise or consist of the nucleotide sequences (sense and antisense strands) shown in Table 10.

TABLE 10

| Sense Sequence | SEQ ID NO: | Antisense Sequence | SEQ ID NO: |
|---|---|---|---|
| ACACCAGAAGUCACAUUUC | 7987 | GAAAUGUGACUUCUGGUGU | 7988 |
| GAAGUCACAUUUCAUCCUU | 7989 | AAGGAUGAAAUGUGACUUC | 7990 |
| AAGUCACAUUUCAUCCUUU | 7991 | AAAGGAUGAAAUGUGACUU | 7992 |
| AGUCACAUUUCAUCCUUUU | 7993 | AAAAGGAUGAAAUGUGACU | 7994 |

TABLE 10-continued

| Sense Sequence | SEQ ID NO: | Antisense Sequence | SEQ ID NO: |
|---|---|---|---|
| UUUCAUCCUUUUACAUGGU | 7995 | ACCAUGUAAAAGGAUGAAA | 7996 |
| UUCAUCCUUUUACAUGGUU | 7997 | AACCAUGUAAAAGGAUGAA | 7998 |
| UCAUCCUUUUACAUGGUUC | 7999 | GAACCAUGUAAAAGGAUGA | 8000 |
| CAUCCUUUUACAUGGUUCC | 8001 | GGAACCAUGUAAAAGGAUG | 8002 |
| UGGUUCCCAUCUACCCUCA | 8003 | UGAGGGUAGAUGGGAACCA | 8004 |
| GGUUCCCAUCUACCCUCAC | 8005 | GUGAGGGUAGAUGGGAACC | 8006 |
| GUUCCCAUCUACCCUCACA | 8007 | UGUGAGGGUAGAUGGGAAC | 8008 |
| GGCAAUUCUUCCUCCAGGA | 8009 | UCCUGGAGGAAGAAUUGCC | 8010 |
| GCAAUUCUUCCUCCAGGAC | 8011 | GUCCUGGAGGAAGAAUUGC | 8012 |
| CAAUUCUUCCUCCAGGACC | 8013 | GGUCCUGGAGGAAGAAUUG | 8014 |
| AAUUCUUCCUCCAGGACCC | 8015 | GGGUCCUGGAGGAAGAAUU | 8016 |
| CCCUUGGACUUUGCCCUUC | 8017 | GAAGGGCAAAGUCCAAGGG | 8018 |
| CCUUGGACUUUGCCCUUCU | 8019 | AGAAGGGCAAAGUCCAAGG | 8020 |
| CUUGGACUUUGCCCUUCUU | 8021 | AAGAAGGGCAAAGUCCAAG | 8022 |
| UUGGACUUUGCCCUUCUUA | 8023 | UAAGAAGGGCAAAGUCCAA | 8024 |
| UGGACUUUGCCCUUCUUAC | 8025 | GUAAGAAGGGCAAAGUCCA | 8026 |
| GGACUUUGCCCUUCUUACU | 8027 | AGUAAGAAGGGCAAAGUCC | 8028 |
| UUUGCCCUUCUUACUGGCC | 8029 | GGCCAGUAAGAAGGGCAAA | 8030 |
| UUGCCCUUCUUACUGGCCA | 8031 | UGGCCAGUAAGAAGGGCAA | 8032 |
| UGCCCUUCUUACUGGCCAG | 8033 | CUGGCCAGUAAGAAGGGCA | 8034 |
| UCUUACUGGCCAGGCAGGG | 8035 | CCCUGCCUGGCCAGUAAGA | 8036 |
| GGCCAGAGUCCAGGCUUGA | 8037 | UCAAGCCUGGACUCUGGCC | 8038 |
| GCCAGAGUCCAGGCUUGAC | 8039 | GUCAAGCCUGGACUCUGGC | 8040 |
| GUCCAGGCUUGACUCAUUC | 8041 | GAAUGAGUCAAGCCUGGAC | 8042 |
| AGGCUUGACUCAUUCCCAC | 8043 | GUGGGAAUGAGUCAAGCCU | 8044 |
| GACUCAUUCCCACCUUGUC | 8045 | GACAAGGUGGGAAUGAGUC | 8046 |
| ACUCAUUCCCACCUUGUCC | 8047 | GGACAAGGUGGGAAUGAGU | 8048 |
| UCAUUCCCACCUUGUCCUG | 8049 | CAGGACAAGGUGGGAAUGA | 8050 |
| CACCUUGUCCUGGGCUGAG | 8051 | CUCAGCCCAGGACAAGGUG | 8052 |
| ACCACCCAGCCCAGAAGUU | 8053 | AACUUCUGGGCUGGGUGGU | 8054 |
| CCACCCAGCCCAGAAGUUC | 8055 | GAACUUCUGGGCUGGGUGG | 8056 |
| CACCCAGCCCAGAAGUUCC | 8057 | GGAACUUCUGGGCUGGGUG | 8058 |
| ACCCAGCCCAGAAGUUCCA | 8059 | UGGAACUUCUGGGCUGGGU | 8060 |
| CCAGAAGUUCCAGGGAAGG | 8061 | CCUUCCCUGGAACUUCUGG | 8062 |
| CAGAAGUUCCAGGGAAGGA | 8063 | UCCUUCCCUGGAACUUCUG | 8064 |
| AACUCUCCGGUCCACCAUG | 8065 | CAUGGUGGACCGGAGAGUU | 8066 |
| ACUCUCCGGUCCACCAUGG | 8067 | CCAUGGUGGACCGGAGAGU | 8068 |
| CACCAUGGAGUACCUCUCA | 8069 | UGAGAGGUACUCCAUGGUG | 8070 |
| ACCAUGGAGUACCUCUCAG | 8071 | CUGAGAGGUACUCCAUGGU | 8072 |
| UGGAGUACCUCUCAGCUCU | 8073 | AGAGCUGAGAGGUACUCCA | 8074 |
| GGAGUACCUCUCAGCUCUG | 8075 | CAGAGCUGAGAGGUACUCC | 8076 |
| GAGUACCUCUCAGCUCUGA | 8077 | UCAGAGCUGAGAGGUACUC | 8078 |
| AGUACCUCUCAGCUCUGAA | 8079 | UUCAGAGCUGAGAGGUACU | 8080 |
| CCAGUGACUUACUCAGGUG | 8081 | CACCUGAGUAAGUCACUGG | 8082 |
| CAGUGACUUACUCAGGUGA | 8083 | UCACCUGAGUAAGUCACUG | 8084 |
| AGUGACUUACUCAGGUGAC | 8085 | GUCACCUGAGUAAGUCACU | 8086 |
| GUGACUUACUCAGGUGACU | 8087 | AGUCACCUGAGUAAGUCAC | 8088 |
| UGACUUACUCAGGUGACUG | 8089 | CAGUCACCUGAGUAAGUCA | 8090 |
| GACUUACUCAGGUGACUGC | 8091 | GCAGUCACCUGAGUAAGUC | 8092 |
| ACUUACUCAGGUGACUGCU | 8093 | AGCAGUCACCUGAGUAAGU | 8094 |
| CUUACUCAGGUGACUGCUA | 8095 | UAGCAGUCACCUGAGUAAG | 8096 |
| UUACUCAGGUGACUGCUAA | 8097 | UUAGCAGUCACCUGAGUAA | 8098 |
| UACUCAGGUGACUGCUAAC | 8099 | GUUAGCAGUCACCUGAGUA | 8100 |
| ACUCAGGUGACUGCUAACC | 8101 | GGUUAGCAGUCACCUGAGU | 8102 |
| CUCAGGUGACUGCUAACCC | 8103 | GGGUUAGCAGUCACCUGAG | 8104 |
| GGUGACUGCUAACCCUCCG | 8105 | CGGAGGGUUAGCAGUCACC | 8106 |
| GUGACUGCUAACCCUCCGC | 8107 | GCGGAGGGUUAGCAGUCAC | 8108 |
| UGACUGCUAACCCUCCGCU | 8109 | AGCGGAGGGUUAGCAGUCA | 8110 |
| GACUGCUAACCCUCCGCUC | 8111 | GAGCGGAGGGUUAGCAGUC | 8112 |
| ACUGCUAACCCUCCGCUCU | 8113 | AGAGCGGAGGGUUAGCAGU | 8114 |
| CUGCUAACCCUCCGCUCUA | 8115 | UAGAGCGGAGGGUUAGCAG | 8116 |
| UGCUAACCCUCCGCUCUAC | 8117 | GUAGAGCGGAGGGUUAGCA | 8118 |
| AACCCUCCGCUCUACCCUC | 8119 | GAGGGUAGAGCGGAGGGUU | 8120 |
| ACUCCACAGUGGGCUUGUC | 8121 | GACAAGCCCACUGUGGAGU | 8122 |
| CUCCACAGUGGGCUUGUCA | 8123 | UGACAAGCCCACUGUGGAG | 8124 |
| UCCACAGUGGGCUUGUCAA | 8125 | UUGACAAGCCCACUGUGGA | 8126 |
| CCACAGUGGGCUUGUCAAG | 8127 | CUUGACAAGCCCACUGUGG | 8128 |
| GUCAAGCUCCUGAGCCACC | 8129 | GGUGGCUCAGGAGCUUGAC | 8130 |
| CCAUGGUCUCUCCCUCAUC | 8131 | GAUGAGGGAGAGACCAUGG | 8132 |
| CAUGGUCUCUCCCUCAUCC | 8133 | GGAUGAGGGAGAGACCAUG | 8134 |
| AUGGUCUCUCCCUCAUCCC | 8135 | GGGAUGAGGGAGAGACCAU | 8136 |
| UCUCUCCCUCAUCCCUAAU | 8137 | UCGAUUAGGGAUGAGGGAG | 8144 |
| CUCUCCCUCAUCCCUAAUC | 8139 | GAUUAGGGAUGAGGGAGAG | 8140 |
| UCUCCCUCAUCCCUAAUCG | 8141 | CGAUUAGGGAUGAGGGAGA | 8142 |
| CUCCCUCAUCCCUAAUCGA | 8143 | UCGAUUAGGGAUGAGGGAG | 8144 |
| UCCCUCAUCCCUAAUCGAU | 8145 | AUCGAUUAGGGAUGAGGGA | 8146 |

TABLE 10-continued

| Sense Sequence | SEQ ID NO: | Antisense Sequence | SEQ ID NO: |
|---|---|---|---|
| CCCUCAUCCCUAAUCGAUA | 8147 | UAUCGAUUAGGGAUGAGGG | 8148 |
| CCUCAUCCCUAAUCGAUAA | 8149 | UUAUCGAUUAGGGAUGAGG | 8150 |
| CUCAUCCCUAAUCGAUAAA | 8151 | UUUAUCGAUUAGGGAUGAG | 8152 |
| AACCUAGAUCUCUCCCUCC | 8153 | GGAGGGAGAGAUCUAGGUU | 8154 |
| ACCUAGAUCUCUCCCUCCC | 8155 | GGGAGGGAGAGAUCUAGGU | 8156 |
| CUAGAUCUCUCCCUCCCUA | 8157 | UAGGGAGGGAGAGAUCUAG | 8158 |
| UAGAUCUCUCCCUCCCUAG | 8159 | CUAGGGAGGGAGAGAUCUA | 8160 |
| AGAUCUCUCCCUCCCUAGC | 8161 | GCUAGGGAGGGAGAGAUCU | 8162 |
| GAUCUCUCCCUCCCUAGCC | 8163 | GGCUAGGGAGGGAGAGAUC | 8164 |
| AUCUCUCCCUCCCUAGCCC | 8165 | GGGCUAGGGAGGGAGAGAU | 8166 |
| UAGCCCUCUAGCCACUCUA | 8167 | UAGAGUGGCUAGAGGGCUA | 8168 |
| AGCCCUCUAGCCACUCUAC | 8169 | GUAGAGUGGCUAGAGGGCU | 8170 |
| CUCUAGCCACUCUACCCUC | 8171 | GAGGGUAGAGUGGCUAGAG | 8172 |
| UCUAGCCACUCUACCCUCA | 8173 | UGAGGGUAGAGUGGCUAGA | 8174 |
| CUAGCCACUCUACCCUCAU | 8175 | AUGAGGGUAGAGUGGCUAG | 8176 |
| UAGCCACUCUACCCUCAUC | 8177 | GAUGAGGGUAGAGUGGCUA | 8178 |
| AGCCACUCUACCCUCAUCA | 8179 | UGAUGAGGGUAGAGUGGCU | 8180 |
| GCCACUCUACCCUCAUCAU | 8181 | AUGAUGAGGGUAGAGUGGC | 8182 |
| CCACUCUACCCUCAUCAUG | 8183 | CAUGAUGAGGGUAGAGUGG | 8184 |
| CACUCUACCCUCAUCAUGC | 8185 | GCAUGAUGAGGGUAGAGUG | 8186 |
| ACUCUACCCUCAUCAUGCC | 8187 | GGCAUGAUGAGGGUAGAGU | 8188 |
| CUCUACCCUCAUCAUGCCC | 8189 | GGGCAUGAUGAGGGUAGAG | 8190 |
| UCUACCCUCAUCAUGCCCU | 8191 | AGGGCAUGAUGAGGGUAGA | 8192 |
| CUACCCUCAUCAUGCCCUU | 8193 | AAGGGCAUGAUGAGGGUAG | 8194 |
| UACCCUCAUCAUGCCCUUU | 8195 | AAAGGGCAUGAUGAGGGUA | 8196 |
| ACCCUCAUCAUGCCCUUUA | 8197 | UAAAGGGCAUGAUGAGGGU | 8198 |
| CCCUCAUCAUGCCCUUUAC | 8199 | GUAAAGGGCAUGAUGAGGG | 8200 |
| CUCAUCAUGCCCUUUACAC | 8201 | GUGUAAAGGGCAUGAUGAG | 8202 |
| UCAUCAUGCCCUUUACACU | 8203 | AGUGUAAAGGGCAUGAUGA | 8204 |
| CCCUUCUUGACUUUUCUUC | 8205 | GAAGAAAAGUCAAGAAGGG | 8206 |
| CUUCUUGACUUUUCUUCUC | 8207 | GAGAAGAAAAGUCAAGAAG | 8208 |
| GACUUUUCUUCUCAACUAC | 8209 | GUAGUUGAGAAGAAAAGUC | 8210 |
| ACUUUUCUUCUCAACUACC | 8211 | GGUAGUUGAGAAGAAAAGU | 8212 |
| CUUUUCUUCUCAACUACCA | 8213 | UGGUAGUUGAGAAGAAAAG | 8214 |
| UUUUCUUCUCAACUACCAG | 8215 | CUGGUAGUUGAGAAGAAAA | 8216 |
| UAUCUAAUAUAAGCUCGGA | 8217 | UCCGAGCUUAUAUUAGAUA | 8218 |
| AUCUAAUAUAAGCUCGGAG | 8219 | CUCCGAGCUUAUAUUAGAU | 8220 |
| UCUAAUAUAAGCUCGGAGU | 8221 | ACUCCGAGCUUAUAUUAGA | 8222 |
| CUAAUAUAAGCUCGGAGUU | 8223 | AACUCCGAGCUUAUAUUAG | 8224 |
| UAAUAUAAGCUCGGAGUUU | 8225 | AAACUCCGAGCUUAUAUUA | 8226 |
| AAUAUAAGCUCGGAGUUUG | 8227 | CAAACUCCGAGCUUAUAUU | 8228 |
| AUAUAAGCUCGGAGUUUGG | 8229 | CCAAACUCCGAGCUUAUAU | 8230 |
| UAUAAGCUCGGAGUUUGGA | 8231 | UCCAAACUCCGAGCUUAUA | 8232 |
| AUAAGCUCGGAGUUUGGAC | 8233 | GUCCAAACUCCGAGCUUAU | 8234 |
| UAAGCUCGGAGUUUGGACG | 8235 | CGUCCAAACUCCGAGCUUA | 8236 |
| AAGCUCGGAGUUUGGACGG | 8237 | CCGUCCAAACUCCGAGCUU | 8238 |
| AGCUCGGAGUUUGGACGGA | 8239 | UCCGUCCAAACUCCGAGCU | 8240 |
| GCUCGGAGUUUGGACGGAG | 8241 | CUCCGUCCAAACUCCGAGC | 8242 |
| CUCGGAGUUUGGACGGAGG | 8243 | CCUCCGUCCAAACUCCGAG | 8244 |
| UCGGAGUUUGGACGGAGGG | 8245 | CCCUCCGUCCAAACUCCGA | 8246 |
| CGGAGUUUGGACGGAGGGU | 8247 | ACCCUCCGUCCAAACUCCG | 8248 |
| UUUGGACGAGGGUCUGGA | 8249 | UCCAGACCCUCCGUCCAAA | 8250 |
| CCCAGCGACCUUUCCGUGU | 8251 | ACACGGAAAGGUCGCUGGG | 8252 |
| CCAGCGACCUUUCCGUGUC | 8253 | GACACGGAAAGGUCGCUGG | 8254 |
| CAGCGACCUUUCCGUGUCU | 8255 | AGACACGGAAAGGUCGCUG | 8256 |
| AGCGACCUUUCCGUGUCUG | 8257 | CAGACACGGAAAGGUCGCU | 8258 |
| GCGACCUUUCCGUGUCUGU | 8259 | ACAGACACGGAAAGGUCGC | 8260 |
| CGACCUUUCCGUGUCUGUG | 8261 | CACAGACACGGAAAGGUCG | 8262 |
| CUUUCCGUGUCUGUGAUCA | 8263 | UGAUCACAGACACGGAAAG | 8264 |
| UUUCCGUGUCUGUGAUCAC | 8265 | GUGAUCACAGACACGGAAA | 8266 |
| UUCCGUGUCUGUGAUCACA | 8267 | UGUGAUCACAGACACGGAA | 8268 |
| AAGGCCUGACAGCUGCCAC | 8269 | GUGGCAGCUGUCAGGCCUU | 8270 |
| GCCAGGAGCUGCUAGCCAA | 8271 | UUGGCUAGCAGCUCCUGGC | 8272 |
| CCAGGAGCUGCUAGCCAAA | 8273 | UUUGGCUAGCAGCUCCUGG | 8274 |
| GAGCUGCUAGCCAAAGUAA | 8275 | UUACUUUGGCUAGCAGCUC | 8276 |
| AGCUGCUAGCCAAAGUAAG | 8277 | CUUACUUUGGCUAGCAGCU | 8278 |
| GCUGCUAGCCAAAGUAAGU | 8279 | ACUUACUUUGGCUAGCAGC | 8280 |
| CUGCUAGCCAAAGUAAGUA | 8281 | UACUUACUUUGGCUAGCAG | 8282 |
| UGCUAGCCAAAGUAAGUAG | 8283 | CUACUUACUUUGGCUAGCA | 8284 |
| GCUAGCCAAAGUAAGUAGG | 8285 | CCUACUUACUUUGGCUAGC | 8286 |
| UAGCCAAAGUAAGUAGGCC | 8287 | GGCCUACUUACUUUGGCUA | 8288 |
| AGCCAAAGUAAGUAGGCCA | 8289 | UGGCCUACUUACUUUGGCU | 8290 |
| GCCAAAGUAAGUAGGCCAA | 8291 | UUGGCCUACUUACUUUGGC | 8292 |
| CCAAAGUAAGUAGGCCAAG | 8293 | CUUGGCCUACUUACUUUGG | 8294 |
| CAAAGUAAGUAGGCCAAGU | 8295 | ACUUGGCCUACUUACUUUG | 8296 |
| AAAGUAAGUAGGCCAAGUU | 8297 | AACUUGGCCUACUUACUUU | 8298 |

TABLE 10-continued

| Sense Sequence | SEQ ID NO: | Antisense Sequence | SEQ ID NO: |
|---|---|---|---|
| AAGUAAGUAGGCCAAGUUC | 8299 | GAACUUGGCCUACUUACUU | 8300 |
| AGUAAGUAGGCCAAGUUCC | 8301 | GGAACUUGGCCUACUUACU | 8302 |
| GUAAGUAGGCCAAGUUCCU | 8303 | AGGAACUUGGCCUACUUAC | 8304 |
| UAAGUAGGCCAAGUUCCUC | 8305 | GAGGAACUUGGCCUACUUA | 8306 |
| UAGGCCAAGUUCCUCGGUU | 8307 | AACCGAGGAACUUGGCCUA | 8308 |
| AGGCCAAGUUCCUCGGUUC | 8309 | GAACCGAGGAACUUGGCCU | 8310 |
| GGCCAAGUUCCUCGGUUCC | 8311 | GGAACCGAGGAACUUGGCC | 8312 |
| GCCAAGUUCCUCGGUUCCU | 8313 | AGGAACCGAGGAACUUGGC | 8314 |
| CCAAGUUCCUCGGUUCCUA | 8315 | UAGGAACCGAGGAACUUGG | 8316 |
| CAAGUUCCUCGGUUCCUAU | 8317 | AUAGGAACCGAGGAACUUG | 8318 |
| AAGUUCCUCGGUUCCUAUA | 8319 | UAUAGGAACCGAGGAACUU | 8320 |
| AGUUCCUCGGUUCCUAUAG | 8321 | CUAUAGGAACCGAGGAACU | 8322 |
| GUUCCUCGGUUCCUAUAGC | 8323 | GCUAUAGGAACCGAGGAAC | 8324 |
| UUCCUCGGUUCCUAUAGCA | 8325 | UGCUAUAGGAACCGAGGAA | 8326 |
| UCCUCGGUUCCUAUAGCAG | 8327 | CUGCUAUAGGAACCGAGGA | 8328 |
| CAGUGGCAACUUGUGAUGA | 8329 | UCAUCACAAGUUGCCACUG | 8330 |
| AGUGGCAACUUGUGAUGAU | 8331 | AUCAUCACAAGUUGCCACU | 8332 |
| GUGGCAACUUGUGAUGAUG | 8333 | CAUCAUCACAAGUUGCCAC | 8334 |
| GGCAACUUGUGAUGAUGGA | 8335 | UCCAUCAUCACAAGUUGCC | 8336 |
| ACUUGUGAUGAUGGAGCAG | 8337 | CUGCUCCAUCAUCACAAGU | 8338 |
| CUUGUGAUGAUGGAGCAGA | 8339 | UCUGCUCCAUCAUCACAAG | 8340 |
| GUGAUGAUGGAGCAGAGGG | 8341 | CCCUCUGCUCCAUCAUCAC | 8342 |
| UGAUGAUGGAGCAGAGGGC | 8343 | GCCCUCUGCUCCAUCAUCA | 8344 |
| UGGAGCAGAGGGCUGAAGU | 8345 | ACUUCAGCCCUCUGCUCCA | 8346 |
| GGAGCAGAGGGCUGAAGUC | 8347 | GACUUCAGCCCUCUGCUCC | 8348 |
| GAGCAGAGGGCUGAAGUCA | 8349 | UGACUUCAGCCCUCUGCUC | 8350 |
| CUAAAAGCAGCGGAGUGGG | 8351 | CCCACUCCGCUGCUUUUAG | 8352 |
| UAAAAGCAGCGGAGUGGGC | 8353 | GCCCACUCCGCUGCUUUUA | 8354 |
| AAAAGCAGCGGAGUGGGCC | 8355 | GGCCCACUCCGCUGCUUUU | 8356 |
| AAAGCAGCGGAGUGGGCCU | 8357 | AGGCCCACUCCGCUGCUUU | 8358 |
| AAGCAGCGGAGUGGGCCUA | 8359 | UAGGCCCACUCCGCUGCUU | 8360 |
| AGCAGCGGAGUGGGCCUAA | 8361 | UUAGGCCCACUCCGCUGCU | 8362 |
| GCAGCGGAGUGGGCCUAAU | 8363 | AUUAGGCCCACUCCGCUGC | 8364 |
| CAGCGGAGUGGGCCUAAUG | 8365 | CAUUAGGCCCACUCCGCUG | 8366 |
| AGCGGAGUGGGCCUAAUGA | 8367 | UCAUUAGGCCCACUCCGCU | 8368 |
| GCGGAGUGGGCCUAAUGAG | 8369 | CUCAUUAGGCCCACUCCGC | 8370 |
| AGUGGGCCUAAUGAGCUCU | 8371 | AGAGCUCAUUAGGCCCACU | 8372 |
| GUGGGCCUAAUGAGCUCUG | 8373 | CAGAGCUCAUUAGGCCCAC | 8374 |
| UGGGCCUAAUGAGCUCUGG | 8375 | CCAGAGCUCAUUAGGCCCA | 8376 |
| GGGCCUAAUGAGCUCUGGU | 8377 | ACCAGAGCUCAUUAGGCCC | 8378 |
| GGCCUAAUGAGCUCUGGUC | 8379 | GACCAGAGCUCAUUAGGCC | 8380 |
| GCCUAAUGAGCUCUGGUCA | 8381 | UGACCAGAGCUCAUUAGGC | 8382 |
| CCUAAUGAGCUCUGGUCAA | 8383 | UUGACCAGAGCUCAUUAGG | 8384 |
| CUAAUGAGCUCUGGUCAAU | 8385 | AUUGACCAGAGCUCAUUAG | 8386 |
| UAAUGAGCUCUGGUCAAUU | 8387 | AAUUGACCAGAGCUCAUUA | 8388 |
| AAUGAGCUCUGGUCAAUUU | 8389 | AAAUUGACCAGAGCUCAUU | 8390 |
| AUGAGCUCUGGUCAAUUUG | 8391 | CAAAUUGACCAGAGCUCAU | 8392 |
| UGAGCUCUGGUCAAUUUGU | 8393 | ACAAAUUGACCAGAGCUCA | 8394 |
| CUGGUCAAUUUGUUCAUUU | 8395 | AAAUGAACAAAUUGACCAG | 8396 |
| CAAUUUGUUCAUUUUCCAC | 8397 | GUGGAAAAUGAACAAAUUG | 8398 |
| AGUGAGCUUUUCUAUGGGA | 8399 | UCCCAUAGAAAAGCUCACU | 8400 |
| AGCUUUUCUAUGGGAGCAG | 8401 | CUGCUCCCAUAGAAAAGCU | 8402 |
| GAAUUCAGAAGCUAGUAUG | 8403 | CAUACUAGCUUCUGAAUUC | 8404 |
| AUUCAGAAGCUAGUAUGGA | 8405 | UCCAUACUAGCUUCUGAAU | 8406 |
| UUCAGAAGCUAGUAUGGAA | 8407 | UUCCAUACUAGCUUCUGAA | 8408 |
| AAAGGUGAUUUGUGUGACA | 8409 | UGUCACACAAAUCACCUUU | 8410 |
| AUUCUGAUUCUGCCACUUC | 8411 | GAAGUGGCAGAAUCAGAAU | 8412 |
| AUUCUGCCACUUCCUGCCU | 8413 | AGGCAGGAAGUGGCAGAAU | 8414 |
| GCCACUUCCUGCCUGUCAA | 8415 | UUGACAGGCAGGAAGUGGC | 8416 |
| CCACUUCCUGCCUGUCAAA | 8417 | UUUGACAGGCAGGAAGUGG | 8418 |
| AACCUUGGGAAGUUGUUCA | 8419 | UGAACAACUUCCCAAGGUU | 8420 |
| ACCUUGGGAAGUUGUUCAA | 8421 | UUGAACAACUUCCCAAGGU | 8422 |
| CCUUGGGAAGUUGUUCAAC | 8423 | GUUGAACAACUUCCCAAGG | 8424 |
| GGGAAGUUGUUCAACCUAC | 8425 | GUAGGUUGAACAACUUCCC | 8426 |
| GGAAGUUGUUCAACCUACC | 8427 | GGUAGGUUGAACAACUUCC | 8428 |
| GAAGUUGUUCAACCUACCA | 8429 | UGGUAGGUUGAACAACUUC | 8430 |
| AAGUUGUUCAACCUACCAA | 8431 | UUGGUAGGUUGAACAACUU | 8432 |
| AGUUGUUCAACCUACCAAA | 8433 | UUUGGUAGGUUGAACAACU | 8434 |
| GUUGUUCAACCUACCAAAA | 8435 | UUUUGGUAGGUUGAACAAC | 8436 |
| GCAAUAAUAUACAUCACC | 8437 | GGUGAUGUAUUAUUAUGC | 8438 |
| AUAAUAUACAUCACCUCC | 8439 | GGAGGUGAUGUAUUAUUAU | 8440 |
| UAAUACAUCACCUCCUAGG | 8441 | CCUAGGAGGUGAUGUAUUA | 8442 |
| AAUACAUCACCUCCUAGGG | 8443 | CCCUAGGAGGUGAUGUAUU | 8444 |
| AUACAUCACCUCCUAGGGU | 8445 | ACCCUAGGAGGUGAUGUAU | 8446 |
| UACAUCACCUCCUAGGGUU | 8447 | AACCCUAGGAGGUGAUGUA | 8448 |
| ACAUCACCUCCUAGGGUUG | 8449 | CAACCCUAGGAGGUGAUGU | 8450 |

TABLE 10-continued

| Sense Sequence | SEQ ID NO: | Antisense Sequence | SEQ ID NO: |
|---|---|---|---|
| AAAGGAGUAAGAGGAUAAU | 8451 | AUUAUCCUCUUACUCCUUU | 8452 |
| AAGGAGUAAGAGGAUAAUG | 8453 | CAUUAUCCUCUUACUCCUU | 8454 |
| AGUAAGAGGAUAAUGUAGG | 8455 | CCUACAUUAUCCUCUUACU | 8456 |
| GUAAGAGGAUAAUGUAGGU | 8457 | ACCUACAUUAUCCUCUUAC | 8458 |
| UAAGAGGAUAAUGUAGGUA | 8459 | UACCUACAUUAUCCUCUUA | 8460 |
| AAGAGGAUAAUGUAGGUAA | 8461 | UUACCUACAUUAUCCUCUU | 8462 |
| AGAGGAUAAUGUAGGUAAA | 8463 | UUUACCUACAUUAUCCUCU | 8464 |
| GAGGAUAAUGUAGGUAAAG | 8465 | CUUUACCUACAUUAUCCUC | 8466 |
| GGAUAAUGUAGGUAAAGUC | 8467 | GACUUUACCUACAUUAUCC | 8468 |
| AUAAUGUAGGUAAAGUCCU | 8469 | AGGACUUUACCUACAUUAU | 8470 |
| GUAGGUAAAGUCCUCAUAC | 8471 | GUAUGAGGACUUUACCUAC | 8472 |
| GUAAAGUCCUCAUACCUGG | 8473 | CCAGGUAUGAGGACUUUAC | 8474 |
| UAAAGUCCUCAUACCUGGC | 8475 | GCCAGGUAUGAGGACUUUA | 8476 |
| AAAGUCCUCAUACCUGGCA | 8477 | UGCCAGGUAUGAGGACUUU | 8478 |
| AAGUCCUCAUACCUGGCAC | 8479 | GUGCCAGGUAUGAGGACUU | 8480 |
| AGUCCUCAUACCUGGCACA | 8481 | UGUGCCAGGUAUGAGGACU | 8482 |
| GUCCUCAUACCUGGCACAG | 8483 | CUGUGCCAGGUAUGAGGAC | 8484 |
| UCCUCAUACCUGGCACAGA | 8485 | UCUGUGCCAGGUAUGAGGA | 8486 |
| UCUUGAGGGUGUGGGAAGU | 8487 | ACUUCCCACACCCUCAAGA | 8488 |
| CUUGAGGGUGUGGGAAGUG | 8489 | CACUUCCCACACCCUCAAG | 8490 |
| UUGAGGGUGUGGGAAGUGA | 8491 | UCACUUCCCACACCCUCAA | 8492 |
| UGAGGGUGUGGGAAGUGAG | 8493 | CUCACUUCCCACACCCUCA | 8494 |
| AGGGUGUGGGAAGUGAGGU | 8495 | ACCUCACUUCCCACACCCU | 8496 |
| GGGUGUGGGAAGUGAGGUG | 8497 | CACCUCACUUCCCACACCC | 8498 |
| GGGAAGUGAGGUGCAGCAU | 8499 | AUGCUGCACCUCACUUCCC | 8500 |
| GGAAGUGAGGUGCAGCAUU | 8501 | AAUGCUGCACCUCACUUCC | 8502 |
| GAAGUGAGGUGCAGCAUUG | 8503 | CAAUGCUGCACCUCACUUC | 8504 |
| AAGUGAGGUGCAGCAUUGU | 8505 | ACAAUGCUGCACCUCACUU | 8506 |
| AGUGAGGUGCAGCAUUGUA | 8507 | UACAAUGCUGCACCUCACU | 8508 |
| GUGAGGUGCAGCAUUGUAG | 8509 | CUACAAUGCUGCACCUCAC | 8510 |
| UGAGGUGCAGCAUUGUAGA | 8511 | UCUACAAUGCUGCACCUCA | 8512 |
| GAGGUGCAGCAUUGUAGAU | 8513 | AUCUACAAUGCUGCACCUC | 8514 |
| AGGUGCAGCAUUGUAGAUA | 8515 | UAUCUACAAUGCUGCACCU | 8516 |
| GGUGCAGCAUUGUAGAUAA | 8517 | UUAUCUACAAUGCUGCACC | 8518 |
| GUGCAGCAUUGUAGAUAAG | 8519 | CUUAUCUACAAUGCUGCAC | 8520 |
| UGCAGCAUUGUAGAUAAGA | 8521 | UCUUAUCUACAAUGCUGCA | 8522 |
| GCAUUGUAGAUAAGACAGA | 8523 | UCUGUCUUAUCUACAAUGC | 8524 |
| CAUUGUAGAUAAGACAGAA | 8525 | UUCUGUCUUAUCUACAAUG | 8526 |
| AUUGUAGAUAAGACAGAAG | 8527 | CUUCUGUCUUAUCUACAAU | 8528 |
| AUAAGACAGAAGGGUGGAC | 8529 | GUCCACCCUUCUGUCUUAU | 8530 |
| UAAGACAGAAGGGUGGACU | 8531 | AGUCCACCCUUCUGUCUUA | 8532 |
| AACCUGGCUUGCUUUCCAA | 8533 | UUGGAAAGCAAGCCAGGUU | 8534 |
| CCUGGCUUGCUUUCCAAUU | 8535 | AAUUGGAAAGCAAGCCAGG | 8536 |
| ACCAGAAGUGACUUGGAGG | 8537 | CCUCCAAGUCACUUCUGGU | 8538 |
| CCAGAAGUGACUUGGAGGG | 8539 | CCCUCCAAGUCACUUCUGG | 8540 |
| AGAUGCCAAUGACAUGGUA | 8541 | UACCAUGUCAUUGGCAUCU | 8542 |
| GAUGCCAAUGACAUGGUAG | 8543 | CUACCAUGUCAUUGGCAUC | 8544 |
| AUGCCAAUGACAUGGUAGG | 8545 | CCUACCAUGUCAUUGGCAU | 8546 |
| CAAUGACAUGGUAGGAGCA | 8547 | UGCUCCUACCAUGUCAUUG | 8548 |
| AAUGACAUGGUAGGAGCAA | 8549 | UUGCUCCUACCAUGUCAUU | 8550 |
| AUGACAUGGUAGGAGCAAA | 8551 | UUUGCUCCUACCAUGUCAU | 8552 |
| UGACAUGGUAGGAGCAAAG | 8553 | CUUUGCUCCUACCAUGUCA | 8554 |
| GACAUGGUAGGAGCAAAGA | 8555 | UCUUUGCUCCUACCAUGUC | 8556 |
| AAAAGGUCAGCCUCUAGCU | 8557 | AGCUAGAGGCUGACCUUUU | 8558 |
| AAAGGUCAGCCUCUAGCUA | 8559 | UAGCUAGAGGCUGACCUUU | 8560 |
| AGGUCAGCCUCUAGCUAGG | 8561 | CCUAGCUAGAGGCUGACCU | 8562 |
| GGUCAGCCUCUAGCUAGGA | 8563 | UCCUAGCUAGAGGCUGACC | 8564 |
| GUCAGCCUCUAGCUAGGAU | 8565 | AUCCUAGCUAGAGGCUGAC | 8566 |
| CAGCCUCUAGCUAGGAUCC | 8567 | GGAUCCUAGCUAGAGGCUG | 8568 |
| AGCCUCUAGCUAGGAUCCC | 8569 | GGGAUCCUAGCUAGAGGCU | 8570 |
| AGAGCUGCAACCUUUAGGA | 8571 | UCCUAAAGGUUGCAGCUCU | 8572 |
| GAGCUGCAACCUUUAGGAG | 8573 | CUCCUAAAGGUUGCAGCUC | 8574 |
| AGCUGCAACCUUUAGGAGG | 8575 | CCUCCUAAAGGUUGCAGCU | 8576 |
| UUUAGGAGGUAUCAAAGUG | 8577 | CACUUUGAUACCUCCUAAA | 8578 |
| UUAGGAGGUAUCAAAGUGC | 8579 | GCACUUUGAUACCUCCUAA | 8580 |
| UAGGAGGUAUCAAAGUGCC | 8581 | GGCACUUUGAUACCUCCUA | 8582 |
| GUCAAAGUGGGACAUCGAC | 8583 | GUCGAUGUCCCACUUUGAC | 8584 |
| CAUCGACCAAUGUCUAGAG | 8585 | CUCUAGACAUUGGUCGAUG | 8586 |
| AUCGACCAAUGUCUAGAGC | 8587 | GCUCUAGACAUUGGUCGAU | 8588 |
| ACCAAUGUCUAGAGCCAAC | 8589 | GUUGGCUCUAGACAUUGGU | 8590 |
| CAAUGUCUAGAGCCAACUG | 8591 | CAGUUGGCUCUAGACAUUG | 8592 |
| AAUGUCUAGAGCCAACUGA | 8593 | UCAGUUGGCUCUAGACAUU | 8594 |
| AUGUCUAGAGCCAACUGAU | 8595 | AUCAGUUGGCUCUAGACAU | 8596 |
| UGUCUAGAGCCAACUGAUG | 8597 | CAUCAGUUGGCUCUAGACA | 8598 |
| GUCUAGAGCCAACUGAUGG | 8599 | CCAUCAGUUGGCUCUAGAC | 8600 |
| UCUAGAGCCAACUGAUGGA | 8601 | UCCAUCAGUUGGCUCUAGA | 8602 |

TABLE 10-continued

| Sense Sequence | SEQ ID NO: | Antisense Sequence | SEQ ID NO: |
|---|---|---|---|
| CUAGAGCCAACUGAUGGAU | 8603 | AUCCAUCAGUUGGCUCUAG | 8604 |
| UAGAGCCAACUGAUGGAUG | 8605 | CAUCCAUCAGUUGGCUCUA | 8606 |
| AGAGCCAACUGAUGGAUGU | 8607 | ACAUCCAUCAGUUGGCUCU | 8608 |
| GAGCCAACUGAUGGAUGUU | 8609 | AACAUCCAUCAGUUGGCUC | 8610 |
| AACUGAUGGAUGUUGGGCA | 8611 | UGCCCAACAUCCAUCAGUU | 8612 |
| UGGAUGUUGGGCAGCUAAA | 8613 | UUUAGCUGCCCAACAUCCA | 8614 |
| GGAUGUUGGGCAGCUAAAG | 8615 | CUUUAGCUGCCCAACAUCC | 8616 |
| GAUGUUGGGCAGCUAAAGA | 8617 | UCUUUAGCUGCCCAACAUC | 8618 |
| UUGGGCAGCUAAAGAGGGA | 8619 | UCCCUCUUUAGCUGCCCAA | 8620 |
| UGGGCAGCUAAAGAGGGAA | 8621 | UUCCCUCUUUAGCUGCCCA | 8622 |
| GGGCAGCUAAAGAGGGAAG | 8623 | CUUCCCUCUUUAGCUGCCC | 8624 |
| GGCAGCUAAAGAGGGAAGG | 8625 | CCUUCCCUCUUUAGCUGCC | 8626 |
| GCAGCUAAAGAGGGAAGGG | 8627 | CCCUUCCCUCUUUAGCUGC | 8628 |
| GGGCAUGGGAUAAGACCUG | 8629 | CAGGUCUUAUCCCAUGCCC | 8630 |
| GGCAUGGGAUAAGACCUGC | 8631 | GCAGGUCUUAUCCCAUGCC | 8632 |
| GCAUGGGAUAAGACCUGCC | 8633 | GGCAGGUCUUAUCCCAUGC | 8634 |
| CAUGGGAUAAGACCUGCCC | 8635 | GGGCAGGUCUUAUCCCAUG | 8636 |
| AUGGGAUAAGACCUGCCCU | 8637 | AGGGCAGGUCUUAUCCCAU | 8638 |
| UGGGAUAAGACCUGCCCUU | 8639 | AAGGGCAGGUCUUAUCCCA | 8640 |
| GGGAUAAGACCUGCCCUUC | 8641 | GAAGGGCAGGUCUUAUCCC | 8642 |
| GGAUAAGACCUGCCCUUCU | 8643 | AGAAGGGCAGGUCUUAUCC | 8644 |
| AGACCUGCCCUUCUUGCUU | 8645 | AAGCAAGAAGGGCAGGUCU | 8646 |
| GACCUGCCCUUCUUGCUUC | 8647 | GAAGCAAGAAGGGCAGGUC | 8648 |
| CCUGCCCUUCUUGCUUCUU | 8649 | AAGAAGCAAGAAGGGCAGG | 8650 |
| CUGCCCUUCUUGCUUCUUG | 8651 | CAAGAAGCAAGAAGGGCAG | 8652 |
| UGCCCUUCUUGCUUCUUGC | 8653 | GCAAGAAGCAAGAAGGGCA | 8654 |
| UCUUGCUUCUUGCCAUUGG | 8655 | CCAAUGGCAAGAAGCAAGA | 8656 |
| CUUGCUUCUUGCCAUUGGG | 8657 | CCCAAUGGCAAGAAGCAAG | 8658 |
| UUGCUUCUUGCCAUUGGGC | 8659 | GCCCAAUGGCAAGAAGCAA | 8660 |
| CCAUUGGGCAGGCAUUGGA | 8661 | UCCAAUGCCUGCCCAAUGG | 8662 |
| CAUUGGGCAGGCAUUGGAG | 8663 | CUCCAAUGCCUGCCCAAUG | 8664 |
| GACCCUACUGCUGAAUGGA | 8665 | UCCAUUCAGCAGUAGGGUC | 8666 |
| UACUGCUGAAUGGAGUGCU | 8667 | AGCACUCCAUUCAGCAGUA | 8668 |
| ACUGCUGAAUGGAGUGCUA | 8669 | UAGCACUCCAUUCAGCAGU | 8670 |
| CUGCUGAAUGGAGUGCUAA | 8671 | UUAGCACUCCAUUCAGCAG | 8672 |
| UGCUGAAUGGAGUGCUAAC | 8673 | GUUAGCACUCCAUUCAGCA | 8674 |
| GCUGAAUGGAGUGCUAACC | 8675 | GGUUAGCACUCCAUUCAGC | 8676 |
| CUGAAUGGAGUGCUAACCC | 8677 | GGGUUAGCACUCCAUUCAG | 8678 |
| UAACCCUGGUGCUAGAGGA | 8679 | UCCUCUAGCACCAGGGUUA | 8680 |
| AACCCUGGUGCUAGAGGAG | 8681 | CUCCUCUAGCACCAGGGUU | 8682 |
| ACCCUGGUGCUAGAGGAGG | 8683 | CCUCCUCUAGCACCAGGGU | 8684 |
| CCCUGGUGCUAGAGGAGGA | 8685 | UCCUCCUCUAGCACCAGGG | 8686 |
| CCUGGUGCUAGAGGAGGAU | 8687 | AUCCUCCUCUAGCACCAGG | 8688 |
| CUGGUGCUAGAGGAGGAUG | 8689 | CAUCCUCCUCUAGCACCAG | 8690 |
| GGUGCUAGAGGAGGAUGGA | 8691 | UCCAUCCUCCUCUAGCACC | 8692 |
| GUGCUAGAGGAGGAUGGAA | 8693 | UUCCAUCCUCCUCUAGCAC | 8694 |
| CUGCAGUGGACAGUGAGGA | 8695 | UCCUCACUGUCCACUGCAG | 8696 |
| UGCAGUGGACAGUGAGGAC | 8697 | GUCCUCACUGUCCACUGCA | 8698 |
| GCAGUGGACAGUGAGGACU | 8699 | AGUCCUCACUGUCCACUGC | 8700 |
| CAGUGGACAGUGAGGACUU | 8701 | AAGUCCUCACUGUCCACUG | 8702 |
| AGUGGACAGUGAGGACUUC | 8703 | GAAGUCCUCACUGUCCACU | 8704 |
| GUGGACAGUGAGGACUUCU | 8705 | AGAAGUCCUCACUGUCCAC | 8706 |
| UGGACAGUGAGGACUUCUU | 8707 | AAGAAGUCCUCACUGUCCA | 8708 |
| GGACAGUGAGGACUUCUUC | 8709 | GAAGAAGUCCUCACUGUCC | 8710 |
| AGUGAGGACUUCUUCCAGC | 8711 | GCUGGAAGAAGUCCUCACU | 8712 |
| GUGAGGACUUCUUCCAGCU | 8713 | AGCUGGAAGAAGUCCUCAC | 8714 |
| UGAGGACUUCUUCCAGCUG | 8715 | CAGCUGGAAGAAGUCCUCA | 8716 |
| GAGGACUUCUUCCAGCUGC | 8717 | GCAGCUGGAAGAAGUCCUC | 8718 |
| GUGCCUGAUGGUGUUGCAG | 8719 | CUGCAACACCAUCAGGCAC | 8720 |
| GAUGGUGUUGCAGUCUGGU | 8721 | ACCAGACUGCAACACCAUC | 8722 |
| UGGUGUUGCAGUCUGGUCA | 8723 | UGACCAGACUGCAACACCA | 8724 |
| GGUGUUGCAGUCUGGUCAG | 8725 | CUGACCAGACUGCAACACC | 8726 |
| GUGUUGCAGUCUGGUCAGA | 8727 | UCUGACCAGACUGCAACAC | 8728 |
| UGCAGUCUGGUCAGAGCUG | 8729 | CAGCUCUGACCAGACUGCA | 8730 |
| GCAGUCUGGUCAGAGCUGG | 8731 | CCAGCUCUGACCAGACUGC | 8732 |
| CAGUCUGGUCAGAGCUGGA | 8733 | UCCAGCUCUGACCAGACUG | 8734 |
| AGUCUGGUCAGAGCUGGAG | 8735 | CUCCAGCUCUGACCAGACU | 8736 |
| GUCUGGUCAGAGCUGGAGC | 8737 | GCUCCAGCUCUGACCAGAC | 8738 |
| UCUGGUCAGAGCUGGAGCC | 8739 | GGCUCCAGCUCUGACCAGA | 8740 |
| UGGUCAGAGCUGGAGCCCU | 8741 | AGGGCUCCAGCUCUGACCA | 8742 |
| GGUCAGAGCUGGAGCCCUA | 8743 | UAGGGCUCCAGCUCUGACC | 8744 |
| GUCAGAGCUGGAGCCCUAC | 8745 | GUAGGGCUCCAGCUCUGAC | 8746 |
| CAAGGGUAAGAGGCCUAUA | 8747 | UAUAGGCCUCUUACCCUUG | 8748 |
| AAGGGUAAGAGGCCUAUAC | 8749 | GUAUAGGCCUCUUACCCUU | 8750 |
| AGGGUAAGAGGCCUAUACU | 8751 | AGUAUAGGCCUCUUACCCU | 8752 |
| GGGUAAGAGGCCUAUACUG | 8753 | CAGUAUAGGCCUCUUACCC | 8754 |

TABLE 10-continued

| Sense Sequence | SEQ ID NO: | Antisense Sequence | SEQ ID NO: |
|---|---|---|---|
| GGUAAGAGGCCUAUACUGG | 8755 | CCAGUAUAGGCCUCUUACC | 8756 |
| GUAAGAGGCCUAUACUGGG | 8757 | CCCAGUAUAGGCCUCUUAC | 8758 |
| GGGCUGCUUCCAAUGCCUG | 8759 | CAGGCAUUGGAAGCAGCCC | 8760 |
| GGCUGCUUCCAAUGCCUGU | 8761 | ACAGGCAUUGGAAGCAGCC | 8762 |
| GCUGCUUCCAAUGCCUGUC | 8763 | GACAGGCAUUGGAAGCAGC | 8764 |
| CUGCUUCCAAUGCCUGUCC | 8765 | GGACAGGCAUUGGAAGCAG | 8766 |
| UGCUUCCAAUGCCUGUCCU | 8767 | AGGACAGGCAUUGGAAGCA | 8768 |
| GCUUCCAAUGCCUGUCCUU | 8769 | AAGGACAGGCAUUGGAAGC | 8770 |
| CUUCCAAUGCCUGUCCUUU | 8771 | AAAGGACAGGCAUUGGAAG | 8772 |
| UUCCAAUGCCUGUCCUUUA | 8773 | UAAAGGACAGGCAUUGGAA | 8774 |
| UCCAAUGCCUGUCCUUUAG | 8775 | CUAAAGGACAGGCAUUGGA | 8776 |
| CAAUGCCUGUCCUUUAGAG | 8777 | CUCUAAAGGACAGGCAUUG | 8778 |
| AAUGCCUGUCCUUUAGAGC | 8779 | GCUCUAAAGGACAGGCAUU | 8780 |
| AUGCCUGUCCUUUAGAGCU | 8781 | AGCUCUAAAGGACAGGCAU | 8782 |
| CUUCCUCUCUAGCUUAACC | 8783 | GGUUAAGCUAGAGAGGAAG | 8784 |
| UUCCUCUCUAGCUUAACCC | 8785 | GGGUUAAGCUAGAGAGGAA | 8786 |
| UCUCUAGCUUAACCCUGAU | 8787 | AUCAGGGUUAAGCUAGAGA | 8788 |
| UAGCUUAACCCUGAUCCUG | 8789 | CAGGAUCAGGGUUAAGCUA | 8790 |
| GACCAGGUGCAGGAGGAGU | 8791 | ACUCCUCCUGCACCUGGUC | 8792 |
| ACCAGGUGCAGGAGGAGUU | 8793 | AACUCCUCCUGCACCUGGU | 8794 |
| CCAGGUGCAGGAGGAGUUG | 8795 | CAACUCCUCCUGCACCUGG | 8796 |
| CAGGUGCAGGAGGAGUUGU | 8797 | ACAACUCCUCCUGCACCUG | 8798 |
| AGGUGCAGGAGGAGUUGUG | 8799 | CACAACUCCUCCUGCACCU | 8800 |
| UGCAGGAGGAGUUGUGGAA | 8801 | UUCCACAACUCCUCCUGCA | 8802 |
| GCAGGAGGAGUUGUGGAAU | 8803 | AUUCCACAACUCCUCCUGC | 8804 |
| AGGAGGAGUUGUGGAAUUG | 8805 | CAAUUCCACAACUCCUCCU | 8806 |
| GGAGGAGUUGUGGAAUUGU | 8807 | ACAAUUCCACAACUCCUCC | 8808 |
| GAGGAGUUGUGGAAUUGUC | 8809 | GACAAUUCCACAACUCCUC | 8810 |
| AGGAGUUGUGGAAUUGUCA | 8811 | UGACAAUUCCACAACUCCU | 8812 |
| GGAGUUGUGGAAUUGUCAA | 8813 | UUGACAAUUCCACAACUCC | 8814 |
| GAGUUGUGGAAUUGUCAAG | 8815 | CUUGACAAUUCCACAACUC | 8816 |
| AGUUGUGGAAUUGUCAAGG | 8817 | CCUUGACAAUUCCACAACU | 8818 |
| GUUGUGGAAUUGUCAAGGA | 8819 | UCCUUGACAAUUCCACAAC | 8820 |
| UGGAAUUGUCAAGGAUGUC | 8821 | GACAUCCUUGACAAUUCCA | 8822 |
| GGAAUUGUCAAGGAUGUCA | 8823 | UGACAUCCUUGACAAUUCC | 8824 |
| AGUCCAAGCGAGGGAGGGU | 8825 | ACCCUCCCUCGCUUGGACU | 8826 |
| CAAGCGAGGGAGGGUCUGA | 8827 | UCAGACCCUCCCUCGCUUG | 8828 |
| AAGCGAGGGAGGGUCUGAC | 8829 | GUCAGACCCUCCCUCGCUU | 8830 |
| CUGACCCAGUGCUGAUGGA | 8831 | UCCAUCAGCACUGGGUCAG | 8832 |
| AGAUUAGUGGUGGGUGUCU | 8833 | AGACACCCACCACUAAUCU | 8834 |
| AUUAGUGGUGGGUGUCUGG | 8835 | CCAGACACCCACCACUAAU | 8836 |
| UUAGUGGUGGGUGUCUGGU | 8837 | ACCAGACACCCACCACUAA | 8838 |
| UAGUGGUGGGUGUCUGGUA | 8839 | UACCAGACACCCACCACUA | 8840 |
| AGUGGUGGGUGUCUGGUAU | 8841 | AUACCAGACACCCACCACU | 8842 |
| GUGGUGGGUGUCUGGUAUG | 8843 | CAUACCAGACACCCACCAC | 8844 |
| UGGUGGGUGUCUGGUAUGA | 8845 | UCAUACCAGACACCCACCA | 8846 |
| GGUGGGUGUCUGGUAUGAG | 8847 | CUCAUACCAGACACCCACC | 8848 |
| GUGGGUGUCUGGUAUGAGG | 8849 | CCUCAUACCAGACACCCAC | 8850 |
| UGGGUGUCUGGUAUGAGGA | 8851 | UCCUCAUACCAGACACCCA | 8852 |
| GGGUGUCUGGUAUGAGGAU | 8853 | AUCCUCAUACCAGACACCC | 8854 |
| GGUGUCUGGUAUGAGGAUC | 8855 | GAUCCUCAUACCAGACACC | 8856 |
| GUGUCUGGUAUGAGGAUCU | 8857 | AGAUCCUCAUACCAGACAC | 8858 |
| UGUCUGGUAUGAGGAUCUA | 8859 | UAGAUCCUCAUACCAGACA | 8860 |
| CAAGGGUGUCCUACAGAGU | 8861 | ACUCUGUAGGACACCCUUG | 8862 |
| AAGGGUGUCCUACAGAGUG | 8863 | CACUCUGUAGGACACCCUU | 8864 |
| AGGGUGUCCUACAGAGUGG | 8865 | CCACUCUGUAGGACACCCU | 8866 |
| GGGUGUCCUACAGAGUGGA | 8867 | UCCACUCUGUAGGACACCC | 8868 |
| GGUGUCCUACAGAGUGGAG | 8869 | CUCCACUCUGUAGGACACC | 8870 |
| UCCUACAGAGUGGAGUGCU | 8871 | AGCACUCCACUCUGUAGGA | 8872 |
| AGUGGAGUGCUGUCAUAUG | 8873 | CAUAUGACAGCACUCCACU | 8874 |
| GUGGAGUGCUGUCAUAUGG | 8875 | CCAUAUGACAGCACUCCAC | 8876 |
| UGGAGUGCUGUCAUAUGGC | 8877 | GCCAUAUGACAGCACUCCA | 8878 |
| GGAGUGCUGUCAUAUGGCC | 8879 | GGCCAUAUGACAGCACUCC | 8880 |
| GAGUGCUGUCAUAUGGCCU | 8881 | AGGCCAUAUGACAGCACUC | 8882 |
| AGUGCUGUCAUAUGGCCUG | 8883 | CAGGCCAUAUGACAGCACU | 8884 |
| GUGCUGUCAUAUGGCCUGG | 8885 | CCAGGCCAUAUGACAGCAC | 8886 |
| UGCUGUCAUAUGGCCUGGG | 8887 | CCCAGGCCAUAUGACAGCA | 8888 |
| GCUGUCAUAUGGCCUGGGA | 8889 | UCCCAGGCCAUAUGACAGC | 8890 |
| CUGUCAUAUGGCCUGGGAC | 8891 | GUCCCAGGCCAUAUGACAG | 8892 |
| UGUCAUAUGGCCUGGGACG | 8893 | CGUCCCAGGCCAUAUGACA | 8894 |
| GUCAUAUGGCCUGGGACGG | 8895 | CCGUCCCAGGCCAUAUGAC | 8896 |
| AGAGGCCCAAGCACAGCAA | 8897 | UUGCUGUGCUUGGGCCUCU | 8898 |
| GAGGCCCAAGCACAGCAAG | 8899 | CUUGCUGUGCUUGGGCCUC | 8900 |
| AGGCCCAAGCACAGCAAGG | 8901 | CCUUGCUGUGCUUGGGCCU | 8902 |
| GGCCCAAGCACAGCAAGGA | 8903 | UCCUUGCUGUGCUUGGGCC | 8904 |
| CCAAGCACAGCAAGGACAU | 8905 | AUGUCCUUGCUGUGCUUGG | 8906 |

TABLE 10-continued

| Sense Sequence | SEQ ID NO: | Antisense Sequence | SEQ ID NO: |
|---|---|---|---|
| GCCCGAUUCACCUUUGACG | 8907 | CGUCAAAGGUGAAUCGGGC | 8908 |
| GAUUCACCUUUGACGUGUA | 8909 | UACACGUCAAAGGUGAAUC | 8910 |
| AUUCACCUUUGACGUGUAC | 8911 | GUACACGUCAAAGGUGAAU | 8912 |
| UUGGCAGCCUGAAUGUCAA | 8913 | UUGACAUUCAGGCUGCCAA | 8914 |
| UGGCAGCCUGAAUGUCAAA | 8915 | UUUGACAUUCAGGCUGCCA | 8916 |
| GGCAGCCUGAAUGUCAAAG | 8917 | CUUUGACAUUCAGGCUGCC | 8918 |
| GCAGCCUGAAUGUCAAAGC | 8919 | GCUUUGACAUUCAGGCUGC | 8920 |
| CAGCCUGAAUGUCAAAGCC | 8921 | GGCUUUGACAUUCAGGCUG | 8922 |
| AGCCUGAAUGUCAAAGCCA | 8923 | UGGCUUUGACAUUCAGGCU | 8924 |
| GCCUGAAUGUCAAAGCCAC | 8925 | GUGGCUUUGACAUUCAGGC | 8926 |
| GUCAAAGCCACAUUCUACG | 8927 | CGUAGAAUGUGGCUUUGAC | 8928 |
| UCAAAGCCACAUUCUACGG | 8929 | CCGUAGAAUGUGGCUUUGA | 8930 |
| CAAAGCCACAUUCUACGGG | 8931 | CCCGUAGAAUGUGGCUUUG | 8932 |
| AAAGCCACAUUCUACGGGC | 8933 | GCCCGUAGAAUGUGGCUUU | 8934 |
| GCCACAUUCUACGGGCUCU | 8935 | AGAGCCCGUAGAAUGUGGC | 8936 |
| CCACAUUCUACGGGCUCUA | 8937 | UAGAGCCCGUAGAAUGUGG | 8938 |
| CACAUUCUACGGGCUCUAC | 8939 | GUAGAGCCCGUAGAAUGUG | 8940 |
| UUCUACGGGCUCUACUCUA | 8941 | UAGAGUAGAGCCCGUAGAA | 8942 |
| UCUACGGGCUCUACUCUAU | 8943 | AUAGAGUAGAGCCCGUAGA | 8944 |
| CUACGGGCUCUACUCUAUG | 8945 | CAUAGAGUAGAGCCCGUAG | 8946 |
| CUCUAUGAGUUGUGACUUU | 8947 | AAAGUCACAACUCAUAGAG | 8948 |
| UCUAUGAGUUGUGACUUUC | 8949 | GAAAGUCACAACUCAUAGA | 8950 |
| UGAGUUGUGACUUUCAAGG | 8951 | CCUUGAAAGUCACAACUCA | 8952 |
| GAGUUGUGACUUUCAAGGA | 8953 | UCCUUGAAAGUCACAACUC | 8954 |
| AGUUGUGACUUUCAAGGAC | 8955 | GUCCUUGAAAGUCACAACU | 8956 |
| GUUGUGACUUUCAAGGACU | 8957 | AGUCCUUGAAAGUCACAAC | 8958 |
| GACUUUCAAGGACUUGGCC | 8959 | GGCCAAGUCCUUGAAAGUC | 8960 |
| UUUCAAGGACUUGGCCCAA | 8961 | UUGGGCCAAGUCCUUGAAA | 8962 |
| UUCAAGGACUUGGCCCAAA | 8963 | UUUGGGCCAAGUCCUUGAA | 8964 |
| CCCUACAGUUGGAUAGUCC | 8965 | GGACUAUCCAACUGUAGGG | 8966 |
| CCUACAGUUGGAUAGUCCC | 8967 | GGGACUAUCCAACUGUAGG | 8968 |
| AUUCGUCCUCUUGCACCCA | 8969 | UGGGUGCAAGAGGACGAAU | 8970 |
| UUCGUCCUCUUGCACCCAC | 8971 | GUGGGUGCAAGAGGACGAA | 8972 |
| UCCUCUUGCACCCACCUAC | 8973 | GUAGGUGGGUGCAAGAGGA | 8974 |
| CCUCUUGCACCCACCUACC | 8975 | GGUAGGUGGGUGCAAGAGG | 8976 |
| CUCUUGCACCCACCUACCC | 8977 | GGGUAGGUGGGUGCAAGAG | 8978 |
| CUAGUUAGCUCUUGCUUGU | 8979 | ACAAGCAAGAGCUAACUAG | 8980 |
| UAGUUAGCUCUUGCUUGUG | 8981 | CACAAGCAAGAGCUAACUA | 8982 |
| AGUUAGCUCUUGCUUGUGG | 8983 | CCACAAGCAAGAGCUAACU | 8984 |
| UUAGCUCUUGCUUGUGGAA | 8985 | UUCCACAAGCAAGAGCUAA | 8986 |
| UCCUCAUCUCCCAGCUUGA | 8987 | UCAAGCUGGGAGAUGAGGA | 8988 |
| AUCUCCCAGCUUGAUGGCU | 8989 | AGCCAUCAAGCUGGGAGAU | 8990 |
| UCUCCCAGCUUGAUGGCUU | 8991 | AAGCCAUCAAGCUGGGAGA | 8992 |
| CUCCCAGCUUGAUGGCUUC | 8993 | GAAGCCAUCAAGCUGGGAG | 8994 |
| UCCCAGCUUGAUGGCUUCC | 8995 | GGAAGCCAUCAAGCUGGGA | 8996 |
| CCCAGCUUGAUGGCUUCCU | 8997 | AGGAAGCCAUCAAGCUGGG | 8998 |
| CCAGCUUGAUGGCUUCCUC | 8999 | GAGGAAGCCAUCAAGCUGG | 9000 |
| UGAUGGCUUCCUCCCAAGU | 9001 | ACUUGGGAGGAAGCCAUCA | 9002 |
| GAUGGCUUCCUCCCAAGUU | 9003 | AACUUGGGAGGAAGCCAUC | 9004 |
| GGCUUCCUCCCAAGUUUUC | 9005 | GAAAACUUGGGAGGAAGCC | 9006 |
| CCUCCCAAGUUUUCCAAAU | 9007 | AUUUGGAAAACUUGGGAGG | 9008 |
| CCCAAGUUUUCCAAAUCAU | 9009 | AUGAUUUGGAAAACUUGGG | 9010 |
| CCAAGUUUUCCAAAUCAUC | 9011 | GAUGAUUUGGAAAACUUGG | 9012 |
| CAAGUUUUCCAAAUCAUCU | 9013 | AGAUGAUUUGGAAAACUUG | 9014 |
| AAGUUUUCCAAAUCAUCUG | 9015 | CAGAUGAUUUGGAAAACUU | 9016 |
| GUUUUCCAAAUCAUCUGAU | 9017 | AUCAGAUGAUUUGGAAAAC | 9018 |
| AUCUGAUUUCCUCUUGUCU | 9019 | AGACAAGAGGAAAUCAGAU | 9020 |
| UCUGAUUUCCUCUUGUCUC | 9021 | GAGACAAGAGGAAAUCAGA | 9022 |
| CUGAUUUCCUCUUGUCUCU | 9023 | AGAGACAAGAGGAAAUCAG | 9024 |
| CUCUUGUCUCUGCCAUUCA | 9025 | UGAAUGGCAGAGACAAGAG | 9026 |
| GUUGGACCUCCACACUGCU | 9027 | AGCAGUGUGGAGGUCCAAC | 9028 |
| CCACACUGCUGCAAGGCCU | 9029 | AGGCCUUGCAGCAGUGUGG | 9030 |
| CACACUGCUGCAAGGCCUG | 9031 | CAGGCCUUGCAGCAGUGUG | 9032 |
| ACACUGCUGCAAGGCCUGG | 9033 | CCAGGCCUUGCAGCAGUGU | 9034 |
| UGCAAGGCCUGGGCCAUAU | 9035 | AUAUGGCCCAGGCCUUGCA | 9036 |
| GCAAGGCCUGGGCCAUAUG | 9037 | CAUAUGGCCCAGGCCUUGC | 9038 |
| CAAGGCCUGGGCCAUAUGU | 9039 | ACAUAUGGCCCAGGCCUUG | 9040 |
| AAGGCCUGGGCCAUAUGUU | 9041 | AACAUAUGGCCCAGGCCUU | 9042 |
| AGGCCUGGGCCAUAUGUUG | 9043 | CAACAUAUGGCCCAGGCCU | 9044 |
| GGCCUGGGCCAUAUGUUGC | 9045 | GCAACAUAUGGCCCAGGCC | 9046 |
| GCCUGGGCCAUAUGUUGCU | 9047 | AGCAACAUAUGGCCCAGGC | 9048 |
| CCUGGGCCAUAUGUUGCUG | 9049 | CAGCAACAUAUGGCCCAGG | 9050 |
| GGCCAUAUGUUGCUGGGAA | 9051 | UUCCCAGCAACAUAUGGCC | 9052 |
| CCAUAUGUUGCUGGGAAUU | 9053 | AAUUCCCAGCAACAUAUGG | 9054 |
| GGAAUUCCUCCACCCUUC | 9055 | GAAGGGUGGAGGAAUUCC | 9056 |
| GAAUUCCUCCACCCUUCG | 9057 | CGAAGGGUGGAGGAAUUC | 9058 |

TABLE 10-continued

| Sense Sequence | SEQ ID NO: | Antisense Sequence | SEQ ID NO: |
|---|---|---|---|
| AAUUCCUCCACCCUUCGU | 9059 | ACGAAGGGUGGAGGAAAUU | 9060 |
| AUUCCUCCACCCUUCGUC | 9061 | GACGAAGGGUGGAGGAAAU | 9062 |
| UUCCUCCACCCUUCGUCA | 9063 | UGACGAAGGGUGGAGGAAA | 9064 |
| UCCUCCACCCUUCGUCAU | 9065 | AUGACGAAGGGUGGAGGAA | 9066 |
| CCUCCACCCUUCGUCAUG | 9067 | CAUGACGAAGGGUGGAGGA | 9068 |
| CUCCACCCUUCGUCAUGC | 9069 | GCAUGACGAAGGGUGGAGG | 9070 |
| CUCCACCCUUCGUCAUGCA | 9071 | UGCAUGACGAAGGGUGGAG | 9072 |
| CCUUCGUCAUGCAGUGGAG | 9073 | CUCCACUGCAUGACGAAGG | 9074 |
| CUUCGUCAUGCAGUGGAGG | 9075 | CCUCCACUGCAUGACGAAG | 9076 |
| UUCGUCAUGCAGUGGAGGG | 9077 | CCCUCCACUGCAUGACGAA | 9078 |
| CGCCUCCAUUCCUACUAAG | 9079 | CUUAGUAGGAAUGGAGGCG | 9080 |
| GCCUCCAUUCCUACUAAGG | 9081 | CCUUAGUAGGAAUGGAGGC | 9082 |
| CCUCCAUUCCUACUAAGGG | 9083 | CCCUUAGUAGGAAUGGAGG | 9084 |
| CAGAAUCAUUCCAACCGAC | 9085 | GUCGGUUGGAAUGAUUCUG | 9086 |
| AGAAUCAUUCCAACCGACC | 9087 | GGUCGGUUGGAAUGAUUCU | 9088 |
| GAAUCAUUCCAACCGACCC | 9089 | GGGUCGGUUGGAAUGAUUC | 9090 |
| AAUCAUUCCAACCGACCCA | 9091 | UGGGUCGGUUGGAAUGAUU | 9092 |
| AUCAUUCCAACCGACCCAC | 9093 | GUGGGUCGGUUGGAAUGAU | 9094 |
| UCAUUCCAACCGACCCACU | 9095 | AGUGGGUCGGUUGGAAUGA | 9096 |
| UCCAACCGACCCACUGCAA | 9097 | UUGCAGUGGGUCGGUUGGA | 9098 |
| CCAACCGACCCACUGCAAA | 9099 | UUUGCAGUGGGUCGGUUGG | 9100 |
| CAACCGACCCACUGCAAAG | 9101 | CUUUGCAGUGGGUCGGUUG | 9102 |
| AACCGACCCACUGCAAAGA | 9103 | UCUUUGCAGUGGGUCGGUU | 9104 |
| ACCGACCCACUGCAAAGAC | 9105 | GUCUUUGCAGUGGGUCGGU | 9106 |
| CCGACCCACUGCAAAGACU | 9107 | AGUCUUUGCAGUGGGUCGG | 9108 |
| CGACCCACUGCAAAGACUA | 9109 | UAGUCUUUGCAGUGGGUCG | 9110 |
| GACCCACUGCAAAGACUAU | 9111 | AUAGUCUUUGCAGUGGGUC | 9112 |
| ACCCACUGCAAAGACUAUG | 9113 | CAUAGUCUUUGCAGUGGGU | 9114 |
| ACUGCAAAGACUAUGACAG | 9115 | CUGUCAUAGUCUUUGCAGU | 9116 |
| CUGCAAAGACUAUGACAGC | 9117 | GCUGUCAUAGUCUUUGCAG | 9118 |
| UGCAAAGACUAUGACAGCA | 9119 | UGCUGUCAUAGUCUUUGCA | 9120 |
| GCAAAGACUAUGACAGCAU | 9121 | AUGCUGUCAUAGUCUUUGC | 9122 |
| AAAGACUAUGACAGCAUCA | 9123 | UGAUGCUGUCAUAGUCUUU | 9124 |
| AAGACUAUGACAGCAUCAA | 9125 | UUGAUGCUGUCAUAGUCUU | 9126 |
| AGACUAUGACAGCAUCAAA | 9127 | UUUGAUGCUGUCAUAGUCU | 9128 |
| GACUAUGACAGCAUCAAAU | 9129 | AUUUGAUGCUGUCAUAGUC | 9130 |
| CUAUGACAGCAUCAAAUUU | 9131 | AAAUUUGAUGCUGUCAUAG | 9132 |
| UAUGACAGCAUCAAAUUUC | 9133 | GAAAUUUGAUGCUGUCAUA | 9134 |
| GCAUCAAAUUUCAGGACCU | 9135 | AGGUCCUGAAAUUUGAUGC | 9136 |
| AUCAAAUUUCAGGACCUGC | 9137 | GCAGGUCCUGAAAUUUGAU | 9138 |
| UCAAAUUUCAGGACCUGCA | 9139 | UGCAGGUCCUGAAAUUUGA | 9140 |
| UUCAGGACCUGCAGACAGU | 9141 | ACUGUCUGCAGGUCCUGAA | 9142 |
| UCAGGACCUGCAGACAGUA | 9143 | UACUGUCUGCAGGUCCUGA | 9144 |
| CAGGACCUGCAGACAGUAC | 9145 | GUACUGUCUGCAGGUCCUG | 9146 |
| AGGACCUGCAGACAGUACA | 9147 | UGUACUGUCUGCAGGUCCU | 9148 |
| GGACCUGCAGACAGUACAG | 9149 | CUGUACUGUCUGCAGGUCC | 9150 |
| CUGCAGACAGUACAGGCUA | 9151 | UAGCCUGUACUGUCUGCAG | 9152 |
| GACAGUACAGGCUAGAUAA | 9153 | UUAUCUAGCCUGUACUGUC | 9154 |
| ACAGUACAGGCUAGAUAAC | 9155 | GUUAUCUAGCCUGUACUGU | 9156 |
| CAGUACAGGCUAGAUAACC | 9157 | GGUUAUCUAGCCUGUACUG | 9158 |
| AGUACAGGCUAGAUAACCC | 9159 | GGGUUAUCUAGCCUGUACU | 9160 |
| GUACAGGCUAGAUAACCCA | 9161 | UGGGUUAUCUAGCCUGUAC | 9162 |
| UACAGGCUAGAUAACCCAC | 9163 | GUGGGUUAUCUAGCCUGUA | 9164 |
| GCUAGAUAACCCACCCAAU | 9165 | AUGGGUGGGUUAUCUAGC | 9166 |
| CUAGAUAACCCACCCAAUU | 9167 | AAUUGGGUGGGUUAUCUAG | 9168 |
| AGAUAACCCACCCAAUUUC | 9169 | GAAAUUGGGUGGGUUAUCU | 9170 |
| GAUAACCCACCCAAUUUCC | 9171 | GGAAAUUGGGUGGGUUAUC | 9172 |
| AACCUUUCAGCAUAACGCC | 9173 | GGCGUUAUGCUGAAAGGUU | 9174 |
| ACCUUUCAGCAUAACGCCU | 9175 | AGGCGUUAUGCUGAAAGGU | 9176 |
| CCUUUCAGCAUAACGCCUC | 9177 | GAGGCGUUAUGCUGAAAGG | 9178 |
| CUUUCAGCAUAACGCCUCA | 9179 | UGAGGCGUUAUGCUGAAAG | 9180 |
| UUUCAGCAUAACGCCUCAC | 9181 | GUGAGGCGUUAUGCUGAAA | 9182 |
| UUCAGCAUAACGCCUCACA | 9183 | UGUGAGGCGUUAUGCUGAA | 9184 |
| UCAGCAUAACGCCUCACAU | 9185 | AUGUGAGGCGUUAUGCUGA | 9186 |
| CAGCAUAACGCCUCACAUC | 9187 | GAUGUGAGGCGUUAUGCUG | 9188 |
| AGCAUAACGCCUCACAUCC | 9189 | GGAUGUGAGGCGUUAUGCU | 9190 |
| GCAUAACGCCUCACAUCCC | 9191 | GGGAUGUGAGGCGUUAUGC | 9192 |
| AACGCCUCACAUCCCAAGU | 9193 | ACUUGGGAUGUGAGGCGUU | 9194 |
| ACGCCUCACAUCCCAAGUC | 9195 | GACUUGGGAUGUGAGGCGU | 9196 |
| CGCCUCACAUCCCAAGUCU | 9197 | AGACUUGGGAUGUGAGGCG | 9198 |
| UCACAUCCCAAGUCUAUAC | 9199 | GUAUAGACUUGGGAUGUGA | 9200 |
| CACAUCCCAAGUCUAUACC | 9201 | GGUAUAGACUUGGGAUGUG | 9202 |
| ACAUCCCAAGUCUAUACCC | 9203 | GGGUAUAGACUUGGGAUGU | 9204 |
| CAUCCCAAGUCUAUACCCU | 9205 | AGGGUAUAGACUUGGGAUG | 9206 |
| AAUGCUGUUCUUUCCUAGC | 9207 | GCUAGGAAAGAACAGCAUU | 9208 |
| AUGCUGUUCUUUCCUAGCC | 9209 | GGCUAGGAAAGAACAGCAU | 9210 |

TABLE 10-continued

| Sense Sequence | SEQ ID NO: | Antisense Sequence | SEQ ID NO: |
|---|---|---|---|
| CUGUUCUUUCCUAGCCACC | 9211 | GGUGGCUAGGAAAGAACAG | 9212 |
| UGUUCUUUCCUAGCCACCU | 9213 | AGGUGGCUAGGAAAGAACA | 9214 |
| GCCAAGAUCAAGAUGUCCC | 9215 | GGGACAUCUUGAUCUUGGC | 9216 |
| UCUUGAUCCCAGCCUGACU | 9217 | AGUCAGGCUGGGAUCAAGA | 9218 |
| CUUGAUCCCAGCCUGACUG | 9219 | CAGUCAGGCUGGGAUCAAG | 9220 |
| UUGAUCCCAGCCUGACUGC | 9221 | GCAGUCAGGCUGGGAUCAA | 9222 |
| UGAUCCCAGCCUGACUGCU | 9223 | AGCAGUCAGGCUGGGAUCA | 9224 |
| CUGACUGCUGCUACAUCUA | 9225 | UAGAUGUAGCAGCAGUCAG | 9226 |
| GACUGCUGCUACAUCUAAU | 9227 | AUUAGAUGUAGCAGCAGUC | 9228 |
| ACUGCUGCUACAUCUAAUC | 9229 | GAUUAGAUGUAGCAGCAGU | 9230 |
| CUGCUGCUACAUCUAAUCC | 9231 | GGAUUAGAUGUAGCAGCAG | 9232 |
| UGCUGCUACAUCUAAUCCC | 9233 | GGGAUUAGAUGUAGCAGCA | 9234 |
| CCUACCAAUGCCUCCUGUC | 9235 | GACAGGAGGCAUUGGUAGG | 9236 |
| CUACCAAUGCCUCCUGUCC | 9237 | GGACAGGAGGCAUUGGUAG | 9238 |
| CCAAUGCCUCCUGUCCCUA | 9239 | UAGGGACAGGAGGCAUUGG | 9240 |
| CAAUGCCUCCUGUCCCUAA | 9241 | UUAGGGACAGGAGGCAUUG | 9242 |
| AAUGCCUCCUGUCCCUAAA | 9243 | UUUAGGGACAGGAGGCAUU | 9244 |
| CCCAGCAUACUGAUGACAG | 9245 | CUGUCAUCAGUAUGCUGGG | 9246 |
| CCAGCAUACUGAUGACAGC | 9247 | GCUGUCAUCAGUAUGCUGG | 9248 |
| CAUACUGAUGACAGCCCUC | 9249 | GAGGGCUGUCAUCAGUAUG | 9250 |
| AUACUGAUGACAGCCCUCU | 9251 | AGAGGGCUGUCAUCAGUAU | 9252 |
| UACUGAUGACAGCCCUCUC | 9253 | GAGAGGGCUGUCAUCAGUA | 9254 |
| ACUGAUGACAGCCCUCUCU | 9255 | AGAGAGGGCUGUCAUCAGU | 9256 |
| CUGAUGACAGCCCUCUCUG | 9257 | CAGAGAGGGCUGUCAUCAG | 9258 |
| UGAUGACAGCCCUCUCUGA | 9259 | UCAGAGAGGGCUGUCAUCA | 9260 |
| GAUGACAGCCCUCUCUGAC | 9261 | GUCAGAGAGGGCUGUCAUC | 9262 |
| AUGACAGCCCUCUCUGACU | 9263 | AGUCAGAGAGGGCUGUCAU | 9264 |
| UGACAGCCCUCUCUGACUU | 9265 | AAGUCAGAGAGGGCUGUCA | 9266 |
| GACAGCCCUCUCUGACUUU | 9267 | AAAGUCAGAGAGGGCUGUC | 9268 |
| ACAGCCCUCUCUGACUUUA | 9269 | UAAAGUCAGAGAGGGCUGU | 9270 |
| CAGCCCUCUCUGACUUUAC | 9271 | GUAAAGUCAGAGAGGGCUG | 9272 |
| AGCCCUCUCUGACUUUACC | 9273 | GGUAAAGUCAGAGAGGGCU | 9274 |
| GCCCUCUCUGACUUUACCU | 9275 | AGGUAAAGUCAGAGAGGGC | 9276 |
| CCCUCUCUGACUUUACCUU | 9277 | AAGGUAAAGUCAGAGAGGG | 9278 |
| CCUCUCUGACUUUACCUUG | 9279 | CAAGGUAAAGUCAGAGAGG | 9280 |
| CUCUCUGACUUUACCUUGA | 9281 | UCAAGGUAAAGUCAGAGAG | 9282 |
| AGAUCUGUCUUCAUACCCU | 9283 | AGGGUAUGAAGACAGAUCU | 9284 |
| GAUCUGUCUUCAUACCCUU | 9285 | AAGGGUAUGAAGACAGAUC | 9286 |
| CUGUCUUCAUACCCUUCCC | 9287 | GGGAAGGGUAUGAAGACAG | 9288 |
| UAUUUACCACUAAGACUUC | 9289 | GAAGUCUUAGUGGUAAAUA | 9290 |
| AUUUACCACUAAGACUUCU | 9291 | AGAAGUCUUAGUGGUAAAU | 9292 |
| UUUACCACUAAGACUUCUG | 9293 | CAGAAGUCUUAGUGGUAAA | 9294 |
| UUACCACUAAGACUUCUGA | 9295 | UCAGAAGUCUUAGUGGUAA | 9296 |
| UACCACUAAGACUUCUGAC | 9297 | GUCAGAAGUCUUAGUGGUA | 9298 |
| ACCACUAAGACUUCUGACU | 9299 | AGUCAGAAGUCUUAGUGGU | 9300 |
| ACUUCUGACUCCAAUUUAA | 9301 | UUAAAUUGGAGUCAGAAGU | 9302 |
| CUUCUGACUCCAAUUUAAA | 9303 | UUUAAAUUGGAGUCAGAAG | 9304 |
| ACACCCAGUCCCAGAUCCA | 9305 | UGGAUCUGGGACUGGGUGU | 9306 |
| CACCCAGUCCCAGAUCCAA | 9307 | UUGGAUCUGGGACUGGGUG | 9308 |
| ACCCAGUCCCAGAUCCAAA | 9309 | UUUGGAUCUGGGACUGGGU | 9310 |

In some embodiments, the siRNA molecules targeted to Transcript D comprise or consist of the nucleotide sequences (sense and antisense strands) shown in Table 11.

TABLE 11

| Sense Sequence | SEQ ID NO: | Antisense Sequence | SEQ ID NO: |
|---|---|---|---|
| UUCCAGCUCAGCAGUGUCU | 9311 | AGACACUGCUGAGCUGGAA | 9312 |
| UCCAGCUCAGCAGUGUCUC | 9313 | GAGACACUGCUGAGCUGGA | 9314 |
| CCAGCUCAGCAGUGUCUCG | 9315 | CGAGACACUGCUGAGCUGG | 9316 |
| CAGCUCAGCAGUGUCUCGU | 9317 | ACGAGACACUGCUGAGCUG | 9318 |
| AGCUCAGCAGUGUCUCGUU | 9319 | AACGAGACACUGCUGAGCU | 9320 |
| GCUCAGCAGUGUCUCGUUC | 9321 | GAACGAGACACUGCUGAGC | 9322 |
| CUCAGCAGUGUCUCGUUCC | 9323 | GGAACGAGACACUGCUGAG | 9324 |
| GUAGCAGACCGACAUCCUU | 9325 | AAGGAUGUCGGUCUGCUAC | 9326 |
| UAGCAGACCGACAUCCUUC | 9327 | GAAGGAUGUCGGUCUGCUA | 9328 |
| AGCAGACCGACAUCCUUCU | 9329 | AGAAGGAUGUCGGUCUGCU | 9330 |
| AGACCGACAUCCUUCUGGG | 9331 | CCCAGAAGGAUGUCGGUCU | 9332 |
| GACCGACAUCCUUCUGGGC | 9333 | GCCCAGAAGGAUGUCGGUC | 9334 |
| CCGACAUCCUUCUGGGCCU | 9335 | AGGCCCAGAAGGAUGUCGG | 9336 |
| CGACAUCCUUCUGGGCCUA | 9337 | UAGGCCCAGAAGGAUGUCG | 9338 |
| GACAUCCUUCUGGGCCUAC | 9339 | GUAGGCCCAGAAGGAUGUC | 9340 |
| CUUCUGGGCCUACAGGUGG | 9341 | CCACCUGUAGGCCCAGAAG | 9342 |
| UUCUGGGCCUACAGGUGGG | 9343 | CCCACCUGUAGGCCCAGAA | 9344 |
| UCUGGGCCUACAGGUGGGU | 9345 | ACCCACCUGUAGGCCCAGA | 9346 |
| GGCCUACAGGUGGGUGGAA | 9347 | UUCCACCCACCUGUAGGCC | 9348 |
| CCUACAGGUGGGUGGAAGG | 9349 | CCUUCCACCCACCUGUAGG | 9350 |

TABLE 11-continued

| Sense Sequence | SEQ ID NO: | Antisense Sequence | SEQ ID NO: |
|---|---|---|---|
| CUACAGGUGGGUGGAAGGC | 9351 | GCCUUCCACCCACCUGUAG | 9352 |
| UACAGGUGGGUGGAAGGCU | 9353 | CGCCUUCCACCCACCUGUA | 9354 |
| ACUUCCCUGCAGCCUGCCU | 9355 | AGGCAGGCUGCAGGGAAGU | 9356 |
| CCUGCAGCCUGCCUCUUUU | 9357 | AAAAGAGGCAGGCUGCAGG | 9358 |
| CUGCAGCCUGCCUCUUUUC | 9359 | GAAAAGAGGCAGGCUGCAG | 9360 |
| GCAGCCUGCCUCUUUUCUG | 9361 | CAGAAAAGAGGCAGGCUGC | 9362 |
| CAGCCUGCCUCUUUUCUGC | 9363 | GCAGAAAAGAGGCAGGCUG | 9364 |
| AGCCUGCCUCUUUUCUGCC | 9365 | GGCAGAAAAGAGGCAGGCU | 9366 |
| GCCUCUUUUCUGCCUGGGA | 9367 | UCCCAGGCAGAAAAGAGGC | 9368 |
| CUUUUCUGCCUGGGAGUCC | 9369 | GGACUCCCAGGCAGAAAAG | 9370 |
| UUUUCUGCCUGGGAGUCCU | 9371 | AGGACUCCCAGGCAGAAAA | 9372 |
| UUCUGCCUGGGAGUCCUGA | 9373 | UCAGGACUCCCAGGCAGAA | 9374 |
| UCUGCCUGGGAGUCCUGAC | 9375 | GUCAGGACUCCCAGGCAGA | 9376 |
| UGCCUGGGAGUCCUGACUU | 9377 | AAGUCAGGACUCCCAGGCA | 9378 |
| GCCUGGGAGUCCUGACUUC | 9379 | GAAGUCAGGACUCCCAGGC | 9380 |
| CUGGGAGUCCUGACUUCCA | 9381 | UGGAAGUCAGGACUCCCAG | 9382 |
| UGGGAGUCCUGACUUCCAC | 9383 | GUGGAAGUCAGGACUCCCA | 9384 |
| GGGAGUCCUGACUUCCACG | 9385 | CGUGGAAGUCAGGACUCCC | 9386 |
| GGAGUCCUGACUUCCACGA | 9387 | UCGUGGAAGUCAGGACUCC | 9388 |
| GAGUCCUGACUUCCACGAG | 9389 | CUCGUGGAAGUCAGGACUC | 9390 |
| AGUCCUGACUUCCACGAGG | 9391 | CCUCGUGGAAGUCAGGACU | 9392 |
| CCUGACUUCCACGAGGACC | 9393 | GGUCCUCGUGGAAGUCAGG | 9394 |
| CUGACUUCCACGAGGACCC | 9395 | GGGUCCUCGUGGAAGUCAG | 9396 |
| UGACUUCCACGAGGACCCA | 9397 | UGGGUCCUCGUGGAAGUCA | 9398 |
| GACUUCCACGAGGACCCAG | 9399 | CUGGGUCCUCGUGGAAGUC | 9400 |
| ACUUCCACGAGGACCCAGA | 9401 | UCUGGGUCCUCGUGGAAGU | 9402 |
| CUUCCACGAGGACCCAGAC | 9403 | GUCUGGGUCCUCGUGGAAG | 9404 |
| UUCCACGAGGACCCAGACC | 9405 | GGUCUGGGUCCUCGUGGAA | 9406 |
| CCCUGCUCCCAGUCAGUUG | 9407 | CAACUGACUGGGAGCAGGG | 9408 |
| CCUGCUCCCAGUCAGUUGA | 9409 | UCAACUGACUGGGAGCAGG | 9410 |
| CUGCUCCCAGUCAGUUGAC | 9411 | GUCAACUGACUGGGAGCAG | 9412 |
| UGCUCCCAGUCAGUUGACC | 9413 | GGUCAACUGACUGGGAGCA | 9414 |
| CCCAGUCAGUUGACCUGCC | 9415 | GGCAGGUCAACUGACUGGG | 9416 |
| CCAGUCAGUUGACCUGCCC | 9417 | GGGCAGGUCAACUGACUGG | 9418 |
| GCCUCCUUCCCAGAGCUCA | 9419 | UGAGCUCUGGGAAGGAGGC | 9420 |
| CCUCCUUCCCAGAGCUCAG | 9421 | CUGAGCUCUGGGAAGGAGG | 9422 |
| CUCCUUCCCAGAGCUCAGU | 9423 | ACUGAGCUCUGGGAAGGAG | 9424 |
| UCCUUCCCAGAGCUCAGUG | 9425 | CACUGAGCUCUGGGAAGGA | 9426 |
| CCUUCCCAGAGCUCAGUGG | 9427 | CCACUGAGCUCUGGGAAGG | 9428 |
| UUCCCAGAGCUCAGUGGUA | 9429 | UACCACUGAGCUCUGGGAA | 9430 |
| UCCCAGAGCUCAGUGGUAA | 9431 | UUACCACUGAGCUCUGGGA | 9432 |
| CAGGCUGUCACUAUCUCUA | 9433 | UAGAGAUAGUGACAGCCUG | 9434 |
| AGGCUGUCACUAUCUCUAC | 9435 | GUAGAGAUAGUGACAGCCU | 9436 |
| UCUCUACCACCACUCCUCU | 9437 | AGAGGAGUGGUGGUAGAGA | 9438 |
| CCACCACUCCUCUAGUCUG | 9439 | CAGACUAGAGGAGUGGUGG | 9440 |
| CACCACUCCUCUAGUCUGG | 9441 | CCAGACUAGAGGAGUGGUG | 9442 |
| ACCACUCCUCUAGUCUGGC | 9443 | GCCAGACUAGAGGAGUGGU | 9444 |
| CCACUCCUCUAGUCUGGCC | 9445 | GGCCAGACUAGAGGAGUGG | 9446 |
| CACUCCUCUAGUCUGGCCC | 9447 | GGGCCAGACUAGAGGAGUG | 9448 |
| AUUCUAGCACAUCUGGGCA | 9449 | UGCCCAGAUGUGCUAGAAU | 9450 |
| UUCUAGCACAUCUGGGCAA | 9451 | UUGCCCAGAUGUGCUAGAA | 9452 |
| UCUAGCACAUCUGGGCAAA | 9453 | UUUGCCCAGAUGUGCUAGA | 9454 |
| CUAGCACAUCUGGGCAAAA | 9455 | UUUUGCCCAGAUGUGCUAG | 9456 |
| GGGUGUAAAGGGACGUGCA | 9457 | UGCACGUCCCUUUACACCC | 9458 |
| GGUGUAAAGGGACGUGCAC | 9459 | GUGCACGUCCCUUUACACC | 9460 |
| GUGUAAAGGGACGUGCACA | 9461 | UGUGCACGUCCCUUUACAC | 9462 |
| UGUAAAGGGACGUGCACAG | 9463 | CUGUGCACGUCCCUUUACA | 9464 |
| GUAAAGGGACGUGCACAGA | 9465 | UCUGUGCACGUCCCUUUAC | 9466 |
| UAAAGGGACGUGCACAGAU | 9467 | AUCUGUGCACGUCCCUUUA | 9468 |
| AAAGGGACGUGCACAGAUC | 9469 | GAUCUGUGCACGUCCCUUU | 9470 |
| AAGGGACGUGCACAGAUCU | 9471 | AGAUCUGUGCACGUCCCUU | 9472 |
| AGGGACGUGCACAGAUCUA | 9473 | UAGAUCUGUGCACGUCCCU | 9474 |
| CGUGCACAGAUCUACUUAC | 9475 | GUAAGUAGAUCUGUGCACG | 9476 |
| GUGCACAGAUCUACUUACC | 9477 | GGUAAGUAGAUCUGUGCAC | 9478 |
| UGCACAGAUCUACUUACCA | 9479 | UGGUAAGUAGAUCUGUGCA | 9480 |
| GCACAGAUCUACUUACCAA | 9481 | UUGGUAAGUAGAUCUGUGC | 9482 |
| CACAGAUCUACUUACCAAG | 9483 | CUUGGUAAGUAGAUCUGUG | 9484 |
| ACAGAUCUACUUACCAAGC | 9485 | GCUUGGUAAGUAGAUCUGU | 9486 |
| CAGAUCUACUUACCAAGCU | 9487 | AGCUUGGUAAGUAGAUCUG | 9488 |
| AGAUCUACUUACCAAGCUG | 9489 | CAGCUUGGUAAGUAGAUCU | 9490 |
| AUCUACUUACCAAGCUGGG | 9491 | CCCAGCUUGGUAAGUAGAU | 9492 |
| UCUACUUACCAAGCUGGGA | 9493 | UCCCAGCUUGGUAAGUAGA | 9494 |
| CUUACCAAGCUGGGAGCAA | 9495 | UUGCUCCCAGCUUGGUAAG | 9496 |
| UUACCAAGCUGGGAGCAAG | 9497 | CUUGCUCCCAGCUUGGUAA | 9498 |
| UACCAAGCUGGGAGCAAGC | 9499 | GCUUGCUCCCAGCUUGGUA | 9500 |
| ACCAAGCUGGGAGCAAGCA | 9501 | UGCUUGCUCCCAGCUUGGU | 9502 |

TABLE 11-continued

| Sense Sequence | SEQ ID NO: | Antisense Sequence | SEQ ID NO: |
| --- | --- | --- | --- |
| GCUGGGAGCAAGCAGGAUU | 9503 | AAUCCUGCUUGCUCCCAGC | 9504 |
| CUGGGAGCAAGCAGGAUUG | 9505 | CAAUCCUGCUUGCUCCCAG | 9506 |
| UGGGAGCAAGCAGGAUUGG | 9507 | CCAAUCCUGCUUGCUCCCA | 9508 |
| GGGAGCAAGCAGGAUUGGG | 9509 | CCCAAUCCUGCUUGCUCCC | 9510 |
| AAAGGUUAAGCAGCAGUAG | 9511 | CUACUGCUGCUUAACCUUU | 9512 |
| AAGGUUAAGCAGCAGUAGG | 9513 | CCUACUGCUGCUUAACCUU | 9514 |
| AGGUUAAGCAGCAGUAGGC | 9515 | GCCUACUGCUGCUUAACCU | 9516 |
| GGUGCCUACUCCUGUCCUG | 9517 | CAGGACAGGAGUAGGCACC | 9518 |
| GUGCCUACUCCUGUCCUGU | 9519 | ACAGGACAGGAGUAGGCAC | 9520 |
| UGCCUACUCCUGUCCUGUG | 9521 | CACAGGACAGGAGUAGGCA | 9522 |
| GCCUACUCCUGUCCUGUGC | 9523 | GCACAGGACAGGAGUAGGC | 9524 |
| CCUACUCCUGUCCUGUGCC | 9525 | GGCACAGGACAGGAGUAGG | 9526 |
| CUACUCCUGUCCUGUGCCU | 9527 | AGGCACAGGACAGGAGUAG | 9528 |
| UACUCCUGUCCUGUGCCUA | 9529 | UAGGCACAGGACAGGAGUA | 9530 |
| ACUCCUGUCCUGUGCCUAU | 9531 | AUAGGCACAGGACAGGAGU | 9532 |
| CUCCUGUCCUGUGCCUAUC | 9533 | GAUAGGCACAGGACAGGAG | 9534 |
| UCCUGUCCUGUGCCUAUCA | 9535 | UGAUAGGCACAGGACAGGA | 9536 |
| GUGCCUAUCACAUUUGCAG | 9537 | CUGCAAAUGUGAUAGGCAC | 9538 |
| CUAUCACAUUUGCAGAGGG | 9539 | CCCUCUGCAAAUGUGAUAG | 9540 |
| UAUCACAUUUGCAGAGGGU | 9541 | ACCCUCUGCAAAUGUGAUA | 9542 |
| AUCACAUUUGCAGAGGGUA | 9543 | UACCCUCUGCAAAUGUGAU | 9544 |
| UCACAUUUGCAGAGGGUAA | 9545 | UUACCCUCUGCAAAUGUGA | 9546 |
| CACAUUUGCAGAGGGUAAG | 9547 | CUUACCCUCUGCAAAUGUG | 9548 |
| ACAUUUGCAGAGGGUAAGA | 9549 | UCUUACCCUCUGCAAAUGU | 9550 |

In some embodiments, the siRNA molecules targeted to Transcript E comprise or consist of the nucleotide sequences (sense and antisense strands) shown in Table 12.

TABLE 12

| Sense Sequence | SEQ ID NO: | Antisense Sequence | SEQ ID NO: |
| --- | --- | --- | --- |
| GACCGCCUGCAGAAGGUUG | 9551 | CAACCUUCUGCAGGCGGUC | 9552 |
| ACCGCCUGCAGAAGGUUGA | 9553 | UCAACCUUCUGCAGGCGGU | 9554 |
| CCGCCUGCAGAAGGUUGAC | 9555 | GUCAACCUUCUGCAGGCGG | 9556 |
| CGCCUGCAGAAGGUUGACU | 9557 | AG UCAACCU UCUGCAGGCG | 9558 |
| GCCUGCAGAAGGUUGACUG | 9559 | CAGUCAACCUUCUGCAGGC | 9560 |
| CAGAAGGUUGACUGCGUGG | 9561 | CCACGCAGUCAACCUUCUG | 9562 |
| AGAAGGUUGACUGCGUGGU | 9563 | ACCACGCAGUCAACCUUCU | 9564 |
| GAAGGUUGACUGCGUGGUA | 9565 | UACCACGCAGUCAACCUU | 9566 |
| AAGGUUGACUGCGUGGUAG | 9567 | CUACCACGCAGUCAACCUU | 9568 |
| AGGUUGACUGCGUGGUAGG | 9569 | CCUACCACGCAGUCAACCU | 9570 |
| GGUUGACUGCGUGGUAGGC | 9571 | CCCUACCACGCAGUCAACC | 9572 |
| CCAGAGCAAGCCGAAGGCA | 9573 | UGCCUUCGGCUUGCUCUGG | 9574 |
| CAGAGCAAGCCGAAGGCAA | 9575 | UUGCCUUCGGCUUGCUCUG | 9576 |
| AGAGCAAGCCGAAGGCAAG | 9577 | CUUGCCUUCGGCUUGCUCU | 9578 |
| GAGCAAGCCGAAGGCAAGC | 9579 | GCUUGCCUUCGGCUUGCUC | 9580 |
| AGCAAGCCGAAGGCAAGCA | 9581 | UGCUUGCCUUCGGCUUGCU | 9582 |
| GCAAGCCGAAGGCAAGCAC | 9583 | GUGCUUGCCUUCGGCUUGC | 9584 |
| CAAGCCGAAGGCAAGCACG | 9585 | CGUGCUUGCCUUCGGCUUG | 9586 |
| AAGCCGAAGGCAAGCACGA | 9587 | UCGUGCUUGCCUUCGGCUU | 9588 |
| AGCCGAAGGCAAGCACGAU | 9589 | AUCGUGCUUGCCUUCGGCU | 9590 |
| GCCGAAGGCAAGCACGAUG | 9591 | CAUCGUGCUUGCCUUCGGC | 9592 |
| AAGGCAAGCACGAUGGCGC | 9593 | GCGCCAUCGUGCUUGCCUU | 9594 |
| AGGCAAGCACGAUGGCGCU | 9595 | AGCGCCAUCGUGCUUGCCU | 9596 |
| AAGCACGAUGGCGCUCACC | 9597 | GGUGAGCGCCAUCGUGCUU | 9598 |
| AGCACGAUGGCGCUCACCA | 9599 | UGGUGAGCGCCAUCGUGCU | 9600 |
| CUGUAGCAGCCGAGCAUCA | 9601 | UGAUGCUCGGCUGCUACAG | 9602 |
| AGCCGAGCAUCAGCCCGAA | 9603 | UUCGGGCUGAUGCUCGGCU | 9604 |
| GUCAGAGUCUCCAGGCUCA | 9605 | UGAGCCUGGAGACUCUGAC | 9606 |
| UCAGAGUCUCCAGGCUCAG | 9607 | CUGAGCCUGGAGACUCUGA | 9608 |
| CAGAGUCUCCAGGCUCAGG | 9609 | CCUGAGCCUGGAGACUCUG | 9610 |
| AGAGUCUCCAGGCUCAGGU | 9611 | ACCUGAGCCUGGAGACUCU | 9612 |
| GAGUCUCCAGGCUCAGGUG | 9613 | CACCUGAGCCUGGAGACUC | 9614 |
| AGUCUCCAGGCUCAGGUGG | 9615 | CCACCUGAGCCUGGAGACU | 9616 |
| GGGUGGCACAGCUGGCAUA | 9617 | UAUGCCAGCUGUGCCACCC | 9618 |
| GUGGCACAGCUGGCAUACG | 9619 | CGUAUGCCAGCUGUGCCAC | 9620 |
| UGGCACAGCUGGCAUACGC | 9621 | GCGUAUGCCAGCUGUGCCA | 9622 |
| CUCCACAGGUGGCGGUAGA | 9623 | UCUACCGCCACCUGUGGAG | 9624 |
| UCCACAGGUGGCGGUAGAC | 9625 | GUCUACCGCCACCUGUGGA | 9626 |
| UGAGCAGCACGCUGGCGUA | 9627 | UACGCCAGCGUGCUGCUCA | 9628 |
| AGCAGCACGCUGGCGUACA | 9629 | UGUACGCCAGCGUGCUGCU | 9630 |
| GCAGCACGCUGGCGUACAU | 9631 | AUGUACGCCAGCGUGCUGC | 9632 |
| CAGCACGCUGGCGUACAUG | 9633 | CAUGUACGCCAGCGUGCUG | 9634 |
| AGCACGCUGGCGUACAUGC | 9635 | GCAUGUACGCCAGCGUGCU | 9636 |
| GCACGCUGGCGUACAUGCU | 9637 | AGCAUGUACGCCAGCGUGC | 9638 |
| CACGCUGGCGUACAUGCUG | 9639 | CAGCAUGUACGCCAGCGUG | 9640 |
| ACGCUGGCGUACAUGCUGA | 9641 | UCAGCAUGUACGCCAGCGU | 9642 |

TABLE 12-continued

| Sense Sequence | SEQ ID NO: | Antisense Sequence | SEQ ID NO: |
|---|---|---|---|
| CUGGCGUACAUGCUGAGCG | 9643 | CGCUCAGCAUGUACGCCAG | 9644 |
| UGGCGUACAUGCUGAGCGC | 9645 | GCGCUCAGCAUGUACGCCA | 9646 |
| CGCGCACACGUAGUACACC | 9647 | GGUGUACUACGUGUGCGCG | 9648 |
| GCGCACACGUAGUACACCG | 9649 | CGGUGUACUACGUGUGCGC | 9650 |
| CGCACACGUAGUACACCGC | 9651 | GCGGUGUACUACGUGUGCG | 9652 |
| GCACACGUAGUACACCGCC | 9653 | GGCGGUGUACUACGUGUGC | 9654 |
| CACACGUAGUACACCGCCU | 9655 | AGGCGGUGUACUACGUGUG | 9656 |
| ACACGUAGUACACCGCCUU | 9657 | AAGGCGGUGUACUACGUGU | 9658 |
| CACGUAGUACACCGCCUUG | 9659 | CAAGGCGGUGUACUACGUG | 9660 |
| UAGUACACCGCCUUGCAGC | 9661 | GCUGCAAGGCGGUGUACUA | 9662 |

In some embodiments, the siRNA molecules targeted to Transcript F comprise or consist of the nucleotide sequences (sense and antisense strands) shown in Table 13.

| Sense Sequence | SEQ ID NO: | Antisense Sequence | SEQ ID NO: |
|---|---|---|---|
| AGUGGACAGUGAGGACUUC | 9663 | GAAGUCCUCACUGUCCACU | 9664 |
| GUGGACAGUGAGGACUUCU | 9665 | AGAAGUCCUCACUGUCCAC | 9666 |
| UGGACAGUGAGGACUUCUU | 9667 | AAGAAGUCCUCACUGUCCA | 9668 |
| GGACAGUGAGGACUUCUUC | 9669 | GAAGAAGUCCUCACUGUCC | 9670 |
| AGUGAGGACUUCUUCCAGC | 9671 | GCUGGAAGAAGUCCUCACU | 9672 |
| GUGAGGACUUCUUCCAGCU | 9673 | AGCUGGAAGAAGUCCUCAC | 9674 |
| UGAGGACUUCUUCCAGCUG | 9675 | CAGCUGGAAGAAGUCCUCA | 9676 |
| GAGGACUUCUUCCAGCUGC | 9677 | GCAGCUGGAAGAAGUCCUC | 9678 |
| GUGCCUGAUGGUGUUGCAG | 9679 | CUGCAACACCAUCAGGCAC | 9680 |
| GAUGGUGUUGCAGUCUGGU | 9681 | ACCAGACUGCAACACCAUC | 9682 |
| UGGUGUUGCAGUCUGGUCA | 9683 | UGACCAGACUGCAACACCA | 9684 |
| GGUGUUGCAGUCUGGUCAG | 9685 | CUGACCAGACUGCAACACC | 9686 |
| GUGUUGCAGUCUGGUCAGA | 9687 | UCUGACCAGACUGCAACAC | 9688 |
| UGCAGUCUGGUCAGAGCUG | 9689 | CAGCUCUGACCAGACUGCA | 9690 |
| GCAGUCUGGUCAGAGCUGG | 9691 | CCAGCUCUGACCAGACUGC | 9692 |
| CAGUCUGGUCAGAGCUGGA | 9693 | UCCAGCUCUGACCAGACUG | 9694 |
| AGUCUGGUCAGAGCUGGAG | 9695 | CUCCAGCUCUGACCAGACU | 9696 |
| GUCUGGUCAGAGCUGGAGC | 9697 | GCUCCAGCUCUGACCAGAC | 9698 |
| UCUGGUCAGAGCUGGAGCC | 9699 | GGCUCCAGCUCUGACCAGA | 9700 |
| UGGUCAGAGCUGGAGCCCU | 9701 | AGGGCUCCAGCUCUGACCA | 9702 |
| GGUCAGAGCUGGAGCCCUA | 9703 | UAGGGCUCCAGCUCUGACC | 9704 |
| GUCAGAGCUGGAGCCCUAC | 9705 | GUAGGGCUCCAGCUCUGAC | 9706 |
| CAAGGGUAAGAGGCCUAUA | 9707 | UAUAGGCCUCUUACCCUUG | 9708 |
| AAGGGUAAGAGGCCUAUAC | 9709 | GUAUAGGCCUCUUACCCUU | 9710 |
| AGGGUAAGAGGCCUAUACU | 9711 | AGUAUAGGCCUCUUACCCU | 9712 |
| GGGUAAGAGGCCUAUACUG | 9713 | CAGUAUAGGCCUCUUACCC | 9714 |
| GGUAAGAGGCCUAUACUGG | 9715 | CCAGUAUAGGCCUCUUACC | 9716 |
| GUAAGAGGCCUAUACUGGG | 9717 | CCCAGUAUAGGCCUCUUAC | 9718 |
| GGGCUGCUUCCAAUGCCUG | 9719 | CAGGCAUUGGAAGCAGCCC | 9720 |
| GGCUGCUUCCAAUGCCUGU | 9721 | ACAGGCAUUGGAAGCAGCC | 9722 |
| GCUGCUUCCAAUGCCUGUC | 9723 | GACAGGCAUUGGAAGCAGC | 9724 |
| CUGCUUCCAAUGCCUGUCC | 9725 | GGACAGGCAUUGGAAGCAG | 9726 |
| UGCUUCCAAUGCCUGUCCU | 9727 | AGGACAGGCAUUGGAAGCA | 9728 |
| GCUUCCAAUGCCUGUCCUU | 9729 | AAGGACAGGCAUUGGAAGC | 9730 |
| CUUCCAAUGCCUGUCCUUU | 9731 | AAAGGACAGGCAUUGGAAG | 9732 |
| UUCCAAUGCCUGUCCUUUA | 9733 | UAAAGGACAGGCAUUGGAA | 9734 |
| UCCAAUGCCUGUCCUUUAG | 9735 | CUAAAGGACAGGCAUUGGA | 9736 |
| CAAUGCCUGUCCUUUAGAG | 9737 | CUCUAAAGGACAGGCAUUG | 9738 |
| AAUGCCUGUCCUUUAGAGC | 9739 | GCUCUAAAGGACAGGCAUU | 9740 |
| AUGCCUGUCCUUUAGAGCU | 9741 | AGCUCUAAAGGACAGGCAU | 9742 |
| CUUCCUCUCUAGCUUAACC | 9743 | GGUUAAGCUAGAGAGGAAG | 9744 |
| UUCCUCUCUAGCUUAACCC | 9745 | GGGUUAAGCUAGAGAGGAA | 9746 |
| UCUCUAGCUUAACCCUGAU | 9747 | AUCAGGGUUAAGCUAGAGA | 9748 |
| UAGCUUAACCCUGAUCCUG | 9749 | CAGGAUCAGGGUUAAGCUA | 9750 |
| GACCAGGUGCAGGAGGAGU | 9751 | ACUCCUCCUGCACCUGGUC | 9752 |
| ACCAGGUGCAGGAGGAGUU | 9753 | AACUCCUCCUGCACCUGGU | 9754 |
| CCAGGUGCAGGAGGAGUUG | 9755 | CAACUCCUCCUGCACCUGG | 9756 |
| CAGGUGCAGGAGGAGUUGU | 9757 | ACAACUCCUCCUGCACCUG | 9758 |
| AGGUGCAGGAGGAGUUGUG | 9759 | CACAACUCCUCCUGCACCU | 9760 |
| UGCAGGAGGAGUUGUGGAA | 9761 | UUCCACAACUCCUCCUGCA | 9762 |
| GCAGGAGGAGUUGUGGAAU | 9763 | AUUCCACAACUCCUCCUGC | 9764 |
| AGGAGGAGUUGUGGAAUUG | 9765 | CAAUUCCACAACUCCUCCU | 9766 |
| GGAGGAGUUGUGGAAUUGU | 9767 | ACAAUUCCACAACUCCUCC | 9768 |
| GAGGAGUUGUGGAAUUGUC | 9769 | GACAAUUCCACAACUCCUC | 9770 |
| AGGAGUUGUGGAAUUGUCA | 9771 | UGACAAUUCCACAACUCCU | 9772 |
| GGAGUUGUGGAAUUGUCAA | 9773 | UUGACAAUUCCACAACUCC | 9774 |
| GAGUUGUGGAAUUGUCAAG | 9775 | CUUGACAAUUCCACAACUC | 9776 |
| AGUUGUGGAAUUGUCAAGG | 9777 | CCUUGACAAUUCCACAACU | 9778 |
| GUUGUGGAAUUGUCAAGGA | 9779 | UCCUUGACAAUUCCACAAC | 9780 |
| UGGAAUUGUCAAGGAUGUC | 9781 | GACAUCCUUGACAAUUCCA | 9782 |

| Sense Sequence | SEQ ID NO: | Antisense Sequence | SEQ ID NO: |
|---|---|---|---|
| GGAAUUGUCAAGGAUGUCA | 9783 | UGACAUCCUUGACAAUUCC | 9784 |
| AGUCCAAGCGAGGGAGGGU | 9785 | ACCCUCCCUCGCUUGGACU | 9786 |
| CAAGCGAGGGAGGGUCUGA | 9787 | UCAGACCCUCCCUCGCUUG | 9788 |
| AAGCGAGGGAGGGUCUGAC | 9789 | GUCAGACCCUCCCUCGCUU | 9790 |
| CUGACCCAGUGCUGAUGGA | 9791 | UCCAUCAGCACUGGGUCAG | 9792 |
| AGAUUAGUGGUGGGUGUCU | 9793 | AGACACCCACCACUAAUCU | 9794 |
| AUUAGUGGUGGGUGUCUGG | 9795 | CCAGACACCCACCACUAAU | 9796 |
| UUAGUGGUGGGUGUCUGGU | 9797 | ACCAGACACCCACCACUAA | 9798 |
| UAGUGGUGGGUGUCUGGUA | 9799 | UACCAGACACCCACCACUA | 9800 |
| AGUGGUGGGUGUCUGGUAU | 9801 | AUACCAGACACCCACCACU | 9802 |
| GUGGUGGGUGUCUGGUAUG | 9803 | CAUACCAGACACCCACCAC | 9804 |
| UGGUGGGUGUCUGGUAUGA | 9805 | UCAUACCAGACACCCACCA | 9806 |
| GGUGGGUGUCUGGUAUGAG | 9807 | CUCAUACCAGACACCCACC | 9808 |
| GUGGGUGUCUGGUAUGAGG | 9809 | CCUCAUACCAGACACCCAC | 9810 |
| UGGGUGUCUGGUAUGAGGA | 9811 | UCCUCAUACCAGACACCCA | 9812 |
| GGGUGUCUGGUAUGAGGAU | 9813 | AUCCUCAUACCAGACACCC | 9814 |
| GGUGUCUGGUAUGAGGAUC | 9815 | GAUCCUCAUACCAGACACC | 9816 |
| GUGUCUGGUAUGAGGAUCU | 9817 | AGAUCCUCAUACCAGACAC | 9818 |
| UGUCUGGUAUGAGGAUCUA | 9819 | UAGAUCCUCAUACCAGACA | 9820 |
| CAAGGGUGUCCUACAGAGU | 9821 | ACUCUGUAGGACACCCUUG | 9822 |
| AAGGGUGUCCUACAGAGUG | 9823 | CACUCUGUAGGACACCCUU | 9824 |
| AGGGUGUCCUACAGAGUGG | 9825 | CCACUCUGUAGGACACCCU | 9826 |
| GGGUGUCCUACAGAGUGGA | 9827 | UCCACUCUGUAGGACACCC | 9828 |
| GGUGUCCUACAGAGUGGAG | 9829 | CUCCACUCUGUAGGACACC | 9830 |
| UCCUACAGAGUGGAGUGCU | 9831 | AGCACUCCACUCUGUAGGA | 9832 |
| AGUGGAGUGCUGUCAUAUG | 9833 | CAUAUGACAGCACUCCACU | 9834 |
| GUGGAGUGCUGUCAUAUGG | 9835 | CCAUAUGACAGCACUCCAC | 9836 |
| UGGAGUGCUGUCAUAUGGC | 9837 | GCCAUAUGACAGCACUCCA | 9838 |
| GGAGUGCUGUCAUAUGGCC | 9839 | GGCCAUAUGACAGCACUCC | 9840 |
| GAGUGCUGUCAUAUGGCCU | 9841 | AGGCCAUAUGACAGCACUC | 9842 |
| AGUGCUGUCAUAUGGCCUG | 9843 | CAGGCCAUAUGACAGCACU | 9844 |
| GUGCUGUCAUAUGGCCUGG | 9845 | CCAGGCCAUAUGACAGCAC | 9846 |
| UGCUGUCAUAUGGCCUGGG | 9847 | CCCAGGCCAUAUGACAGCA | 9848 |
| GCUGUCAUAUGGCCUGGGA | 9849 | UCCCAGGCCAUAUGACAGC | 9850 |
| CUGUCAUAUGGCCUGGGAC | 9851 | GUCCCAGGCCAUAUGACAG | 9852 |
| UGUCAUAUGGCCUGGGACG | 9853 | CGUCCCAGGCCAUAUGACA | 9854 |
| GUCAUAUGGCCUGGGACGG | 9855 | CCGUCCCAGGCCAUAUGAC | 9856 |
| AGAGGCCCAAGCACAGCAA | 9857 | UUGCUGUGCUUGGGCCUCU | 9858 |
| GAGGCCCAAGCACAGCAAG | 9859 | CUUGCUGUGCUUGGGCCUC | 9860 |
| AGGCCCAAGCACAGCAAGG | 9861 | CCUUGCUGUGCUUGGGCCU | 9862 |
| GGCCCAAGCACAGCAAGGA | 9863 | UCCUUGCUGUGCUUGGGCC | 9864 |
| CCAAGCACAGCAAGGACAU | 9865 | AUGUCCUUGCUGUGCUUGG | 9866 |
| GCCCGAUUCACCUUUGACG | 9867 | CGUCAAAGGUGAAUCGGGC | 9868 |
| GAUUCACCUUUGACGUGUA | 9869 | UACACGUCAAAGGUGAAUC | 9870 |
| AUUCACCUUUGACGUGUAC | 9871 | GUACACGUCAAAGGUGAAU | 9872 |
| UUGGCAGCCUGAAUGUCAA | 9873 | UUGACAUUCAGGCUGCCAA | 9874 |
| UGGCAGCCUGAAUGUCAAA | 9875 | UUUGACAUUCAGGCUGCCA | 9876 |
| GGCAGCCUGAAUGUCAAAG | 9877 | CUUUGACAUUCAGGCUGCC | 9878 |
| GCAGCCUGAAUGUCAAAGC | 9879 | GCUUUGACAUUCAGGCUGC | 9880 |
| CAGCCUGAAUGUCAAAGCC | 9881 | GGCUUUGACAUUCAGGCUG | 9882 |
| AGCCUGAAUGUCAAAGCCA | 9883 | UGGCUUUGACAUUCAGGCU | 9884 |
| GCCUGAAUGUCAAAGCCAC | 9885 | GUGGCUUUGACAUUCAGGC | 9886 |
| GUCAAAGCCACAUUCUACG | 9887 | CGUAGAAUGUGGCUUUGAC | 9888 |
| UCAAAGCCACAUUCUACGG | 9889 | CCGUAGAAUGUGGCUUUGA | 9890 |
| CAAAGCCACAUUCUACGGG | 9891 | CCCGUAGAAUGUGGCUUUG | 9892 |
| AAAGCCACAUUCUACGGGC | 9893 | GCCCGUAGAAUGUGGCUUU | 9894 |
| GCCACAUUCUACGGGCUCU | 9895 | AGAGCCCGUAGAAUGUGGC | 9896 |
| CCACAUUCUACGGGCUCUA | 9897 | UAGAGCCCGUAGAAUGUGG | 9898 |
| CACAUUCUACGGGCUCUAC | 9899 | GUAGAGCCCGUAGAAUGUG | 9900 |
| UUCUACGGGCUCUACUCUA | 9901 | UAGAGUAGAGCCCGUAGAA | 9902 |
| UCUACGGGCUCUACUCUAU | 9903 | AUAGAGUAGAGCCCGUAGA | 9904 |
| CUACGGGCUCUACUCUAUG | 9905 | CAUAGAGUAGAGCCCGUAG | 9906 |
| CUCUAUGAGUUGUGACUUU | 9907 | AAAGUCACAACUCAUAGAG | 9908 |
| UCUAUGAGUUGUGACUUUC | 9909 | GAAAGUCACAACUCAUAGA | 9910 |
| UGAGUUGUGACUUUCAAGG | 9911 | CCUUGAAAGUCACAACUCA | 9912 |
| GAGUUGUGACUUUCAAGGA | 9913 | UCCUUGAAAGUCACAACUC | 9914 |
| AGUUGUGACUUUCAAGGAC | 9915 | GUCCUUGAAAGUCACAACU | 9916 |
| GUUGUGACUUUCAAGGACU | 9917 | AGUCCUUGAAAGUCACAAC | 9918 |
| GACUUUCAAGGACUUGGCC | 9919 | GGCCAAGUCCUUGAAAGUC | 9920 |
| UUUCAAGGACUUGGCCCAA | 9921 | UUGGGCCAAGUCCUUGAAA | 9922 |
| UUCAAGGACUUGGCCCAAA | 9923 | UUUGGGCCAAGUCCUUGAA | 9924 |
| CCCUACAGUUGGAUAGUCC | 9925 | GGACUAUCCAACUGUAGGG | 9926 |
| CCUACAGUUGGAUAGUCCC | 9927 | GGGACUAUCCAACUGUAGG | 9928 |
| AUUCGUCCUCUUGCACCCA | 9929 | UGGGUGCAAGAGGACGAAU | 9930 |
| UUCGUCCUCUUGCACCCAC | 9931 | GUGGGUGCAAGAGGACGAA | 9932 |

| Sense Sequence | SEQ ID NO: | Antisense Sequence | SEQ ID NO: |
|---|---|---|---|
| UCCUCUUGCACCCACCUAC | 9933 | GUAGGUGGGUGCAAGAGGA | 9934 |
| CCUCUUGCACCCACCUACC | 9935 | GGUAGGUGGGUGCAAGAGG | 9936 |
| CUCUUGCACCCACCUACCC | 9937 | GGGUAGGUGGGUGCAAGAG | 9938 |
| CUAGUUAGCUCUUGCUUGU | 9939 | ACAAGCAAGAGCUAACUAG | 9940 |
| UAGUUAGCUCUUGCUUGUG | 9941 | CACAAGCAAGAGCUAACUA | 9942 |
| AGUUAGCUCUUGCUUGUGG | 9943 | CCACAAGCAAGAGCUAACU | 9944 |
| UUAGCUCUUGCUUGUGGAA | 9945 | UUCCACAAGCAAGAGCUAA | 9946 |
| UCCUCAUCUCCCAGCUUGA | 9947 | UCAAGCUGGGAGAUGAGGA | 9948 |
| AUCUCCCAGCUUGAUGGCU | 9949 | AGCCAUCAAGCUGGGAGAU | 9950 |
| UCUCCCAGCUUGAUGGCUU | 9951 | AAGCCAUCAAGCUGGGAGA | 9952 |
| CUCCCAGCUUGAUGGCUUC | 9953 | GAAGCCAUCAAGCUGGGAG | 9954 |
| UCCCAGCUUGAUGGCUUCC | 9955 | GGAAGCCAUCAAGCUGGGA | 9956 |
| CCCAGCUUGAUGGCUUCCU | 9957 | AGGAAGCCAUCAAGCUGGG | 9958 |
| CCAGCUUGAUGGCUUCCUC | 9959 | GAGGAAGCCAUCAAGCUGG | 9960 |
| UGAUGGCUUCCUCCCAAGU | 9961 | ACUUGGGAGGAAGCCAUCA | 9962 |
| GAUGGCUUCCUCCCAAGUU | 9963 | AACUUGGGAGGAAGCCAUC | 9964 |
| GGCUUCCUCCCAAGUUUUC | 9965 | GAAAACUUGGGAGGAAGCC | 9966 |
| CCUCCCAAGUUUUCCAAAU | 9967 | AUUUGGAAAACUUGGGAGG | 9968 |
| CCCAAGUUUUCCAAAUCAU | 9969 | AUGAUUUGGAAAACUUGGG | 9970 |
| CCAAGUUUUCCAAAUCAUC | 9971 | GAUGAUUUGGAAAACUUGG | 9972 |
| CAAGUUUUCCAAAUCAUCU | 9973 | AGAUGAUUUGGAAAACUUG | 9974 |
| AAGUUUUCCAAAUCAUCUG | 9975 | CAGAUGAUUUGGAAAACUU | 9976 |
| GUUUUCCAAAUCAUCUGAU | 9977 | AUCAGAUGAUUUGGAAAAC | 9978 |
| AUCUGAUUUCCUCUUGUCU | 9979 | AGACAAGAGGAAAUCAGAU | 9980 |
| UCUGAUUUCCUCUUGUCUC | 9981 | GAGACAAGAGGAAAUCAGA | 9982 |
| CUGAUUUCCUCUUGUCUCU | 9983 | AGAGACAAGAGGAAAUCAG | 9984 |
| CUCUUGUCUCUGCCAUUCA | 9985 | UGAAUGGCAGAGACAAGAG | 9986 |
| GUUGGACCUCCACACUGCU | 9987 | AGCAGUGUGGAGGUCCAAC | 9988 |
| CCACACUGCUGCAAGGCCU | 9989 | AGGCCUUGCAGCAGUGUGG | 9990 |
| CACACUGCUGCAAGGCCUG | 9991 | CAGGCCUUGCAGCAGUGUG | 9992 |
| ACACUGCUGCAAGGCCUGG | 9993 | CCAGGCCUUGCAGCAGUGU | 9994 |
| UGCAAGGCCUGGGCCAUAU | 9995 | AUAUGGCCCAGGCCUUGCA | 9996 |
| GCAAGGCCUGGGCCAUAUG | 9997 | CAUAUGGCCCAGGCCUUGC | 9998 |
| CAAGGCCUGGGCCAUAUGU | 9999 | ACAUAUGGCCCAGGCCUUG | 10000 |
| AAGGCCUGGGCCAUAUGUU | 10001 | AACAUAUGGCCCAGGCCUU | 10002 |
| AGGCCUGGGCCAUAUGUUG | 10003 | CAACAUAUGGCCCAGGCCU | 10004 |
| GGCCUGGGCCAUAUGUUGC | 10005 | GCAACAUAUGGCCCAGGCC | 10006 |
| GCCUGGGCCAUAUGUUGCU | 10007 | AGCAACAUAUGGCCCAGGC | 10008 |
| CCUGGGCCAUAUGUUGCUG | 10009 | CAGCAACAUAUGGCCCAGG | 10010 |
| GGCCAUAUGUUGCUGGGAA | 10011 | UUCCCAGCAACAUAUGGCC | 10012 |
| CCAUAUGUUGCUGGGAAUU | 10013 | AAUUCCCAGCAACAUAUGG | 10014 |
| GGAAUUCCUCCACCCUUC | 10015 | GAAGGGUGGAGGAAAUUCC | 10016 |
| GAAUUCCUCCACCCUUCG | 10017 | CGAAGGGUGGAGGAAAUUC | 10018 |
| AAUUCCUCCACCCUUCGU | 10019 | ACGAAGGGUGGAGGAAAUU | 10020 |
| AUUCCUCCACCCUUCGUC | 10021 | GACGAAGGGUGGAGGAAAU | 10022 |
| UUUCCUCCACCCUUCGUCA | 10023 | UGACGAAGGGUGGAGGAAA | 10024 |
| UUCCUCCACCCUUCGUCAU | 10025 | AUGACGAAGGGUGGAGGAA | 10026 |
| UCCUCCACCCUUCGUCAUG | 10027 | CAUGACGAAGGGUGGAGGA | 10028 |
| CCUCCACCCUUCGUCAUGC | 10029 | GCAUGACGAAGGGUGGAGG | 10030 |
| CUCCACCCUUCGUCAUGCA | 10031 | UGCAUGACGAAGGGUGGAG | 10032 |
| CCUUCGUCAUGCAGUGGAG | 10033 | CUCCACUGCAUGACGAAGG | 10034 |
| CUUCGUCAUGCAGUGGAGG | 10035 | CCUCCACUGCAUGACGAAG | 10036 |
| UUCGUCAUGCAGUGGAGGG | 10037 | CCCUCCACUGCAUGACGAA | 10038 |
| CGCCUCCAUUCCUACUAAG | 10039 | CUUAGUAGGAAUGGAGGCG | 10040 |
| GCCUCCAUUCCUACUAAGG | 10041 | CCUUAGUAGGAAUGGAGGC | 10042 |
| CCUCCAUUCCUACUAAGGG | 10043 | CCCUUAGUAGGAAUGGAGG | 10044 |

In some embodiments, the PNPLA3 inhibitor comprises an inhibitory nucleic acid molecule. Examples of inhibitory nucleic acid molecules include, but are not limited to, antisense nucleic acid molecules, siRNAs, and shRNAs. Such inhibitory nucleic acid molecules can be designed to target any region of a PNPLA3 mRNA. In some embodiments, the antisense RNA, siRNA, or shRNA hybridizes to a sequence within a PNPLA3 genomic nucleic acid molecule or mRNA molecule and decreases expression of the PNPLA3 polypeptide in a cell in the subject. In some embodiments, the PNPLA3 inhibitor comprises an antisense RNA that hybridizes to a PNPLA3 genomic nucleic acid molecule or mRNA molecule and decreases expression of the PNPLA3 polypeptide in a cell in the subject. In some embodiments, the PNPLA3 inhibitor comprises an siRNA that hybridizes to a PNPLA3 genomic nucleic acid molecule or mRNA molecule and decreases expression of the PNPLA3 polypeptide in a cell in the subject. In some embodiments, the PNPLA3 inhibitor comprises an shRNA that hybridizes to a PNPLA3 genomic nucleic acid molecule or mRNA molecule and decreases expression of the PNPLA3 polypeptide in a cell in the subject.

The inhibitory nucleic acid molecules described herein can be targeted to various PNPLA3 transcripts. For example, the inhibitory nucleic acid molecules described herein can be targeted to the PNPLA3 transcripts (derived from chromosome 22; Ensembl Gene ID=ENSG00000100344.11; hgnc symbol=PNPLA3).

In some embodiments, the HSD17B13 inhibitor comprises an inhibitory nucleic acid molecule. Examples of inhibitory nucleic acid molecules include, but are not limited to, antisense nucleic acid molecules, siRNAs, and shRNAs. Such inhibitory nucleic acid molecules can be designed to target any region of a HSD17B13 mRNA. In some embodiments, the antisense RNA, siRNA, or shRNA hybridizes to a sequence within a HSD17B13 genomic nucleic acid molecule or mRNA molecule and decreases expression of the HSD17B13 polypeptide in a cell in the subject. In some embodiments, the HSD17B13 inhibitor comprises an antisense RNA that hybridizes to a HSD17B13 genomic nucleic acid molecule or mRNA molecule and decreases expression of the HSD17B13 polypeptide in a cell in the subject. In some embodiments, the HSD17B13 inhibitor comprises an siRNA that hybridizes to a HSD17B13 genomic nucleic acid molecule or mRNA molecule and decreases expression of the HSD17B13 polypeptide in a cell in the subject. In some embodiments, the HSD17B13 inhibitor comprises an shRNA that hybridizes to a HSD17B13 genomic nucleic acid molecule or mRNA molecule and decreases expression of the HSD17B13 polypeptide in a cell in the subject.

The inhibitory nucleic acid molecules described herein can be targeted to various HSD17B13 transcripts. For example, the inhibitory nucleic acid molecules described herein can be targeted to the HSD17B13 transcripts (derived from chromosome 4; Ensembl Gene ID=ENSG00000170509.8; hgnc symbol=HSD17B13).

The inhibitory nucleic acid molecules disclosed herein can comprise RNA, DNA, or both RNA and DNA. The inhibitory nucleic acid molecules can also be linked or fused to a heterologous nucleic acid sequence, such as in a vector, or a heterologous label. For example, the inhibitory nucleic acid molecules disclosed herein can be within a vector or as an exogenous donor sequence comprising the inhibitory nucleic acid molecule and a heterologous nucleic acid sequence. The inhibitory nucleic acid molecules can also be linked or fused to a heterologous label. The label can be directly detectable (such as, for example, fluorophore) or indirectly detectable (such as, for example, hapten, enzyme, or fluorophore quencher). Such labels can be detectable by spectroscopic, photochemical, biochemical, immunochemical, or chemical means. Such labels include, for example, radiolabels, pigments, dyes, chromogens, spin labels, and fluorescent labels. The label can also be, for example, a chemiluminescent substance; a metal-containing substance; or an enzyme, where there occurs an enzyme-dependent secondary generation of signal. The term "label" can also refer to a "tag" or hapten that can bind selectively to a conjugated molecule such that the conjugated molecule, when added subsequently along with a substrate, is used to generate a detectable signal. For example, biotin can be used as a tag along with an avidin or streptavidin conjugate of horseradish peroxidate (HRP) to bind to the tag, and examined using a calorimetric substrate (such as, for example, tetramethylbenzidine (TMB)) or a fluorogenic substrate to detect the presence of HRP. Exemplary labels that can be used as tags to facilitate purification include, but are not limited to, myc, HA, FLAG or 3×FLAG, 6×His (SEQ ID NO:10045) or polyhistidine, glutathione-S-transferase (GST), maltose binding protein, an epitope tag, or the Fc portion of immunoglobulin. Numerous labels include, for example, particles, fluorophores, haptens, enzymes and their calorimetric, fluorogenic and chemiluminescent substrates and other labels.

The inhibitory nucleic acid molecules disclosed herein can comprise, for example, nucleotides or non-natural or modified nucleotides, such as nucleotide analogs or nucleotide substitutes. Such nucleotides include a nucleotide that contains a modified base, sugar, or phosphate group, or that incorporates a non-natural moiety in its structure. Examples of non-natural nucleotides include, but are not limited to, dideoxynucleotides, biotinylated, aminated, deaminated, alkylated, benzylated, and fluorophor-labeled nucleotides.

The inhibitory nucleic acid molecules disclosed herein can also comprise one or more nucleotide analogs or substitutions. A nucleotide analog is a nucleotide which contains a modification to either the base, sugar, or phosphate moieties. Modifications to the base moiety include, but are not limited to, natural and synthetic modifications of A, C, G, and T/U, as well as different purine or pyrimidine bases such as, for example, pseudouridine, uracil-5-yl, hypoxanthin-9-yl (I), and 2-aminoadenin-9-yl. Modified bases include, but are not limited to, 5-methylcytosine (5-me-C), 5-hydroxymethyl cytosine, xanthine, hypoxanthine, 2-aminoadenine, 6-methyl and other alkyl derivatives of adenine and guanine, 2-propyl and other alkyl derivatives of adenine and guanine, 2-thiouracil, 2-thiothymine and 2-thiocytosine, 5-halouracil and cytosine, 5-propynyl uracil and cytosine, 6-azo uracil, cytosine and thymine, 5-uracil (pseudouracil), 4-thiouracil, 8-halo, 8-amino, 8-thiol, 8-thioalkyl, 8-hydroxyl and other 8-substituted adenines and guanines, 5-halo (such as, for example, 5-bromo), 5-trifluoromethyl and other 5-substituted uracils and cytosines, 7-methylguanine, 7-methyladenine, 8-azaguanine, 8-azaadenine, 7-deazaguanine, 7-deazaadenine, 3-deazaguanine, and 3-deazaadenine.

Nucleotide analogs can also include modifications of the sugar moiety. Modifications to the sugar moiety include, but are not limited to, natural modifications of the ribose and deoxy ribose as well as synthetic modifications. Sugar modifications include, but are not limited to, the following modifications at the 2' position: OH; F; O-, S-, or N-alkyl; O-, S-, or N-alkenyl; O-, S- or N-alkynyl; or O-alkyl-O-alkyl, wherein the alkyl, alkenyl, and alkynyl may be substituted or unsubstituted $C_{1-10}$alkyl or $C_{2-10}$alkenyl, and $C_{2-10}$alkynyl. Exemplary 2' sugar modifications also include, but are not limited to, $-O[(CH_2)_nO]_mCH_3$, $-O(CH_2)_nOCH_3$, $-O(CH_2)_nNH_2$, $-O(CH_2)_nCH_3$, $-O(CH_2)_n-ONH_2$, and $-O(CH_2)_nON[(CH_2)_nCH_3)]_2$, where n and m, independently, are from 1 to about 10. Other modifications at the 2' position include, but are not limited to, $C_{1-10}$alkyl, substituted lower alkyl, alkaryl, aralkyl, O-alkaryl or O-aralkyl, SH, $SCH_3$, OCN, Cl, Br, CN, $CF_3$, $OCF_3$, $SOCH_3$, $SO_2CH_3$, $ONO_2$, $NO_2$, $N_3$, $NH_2$, heterocycloalkyl, heterocycloalkaryl, aminoalkylamino, polyalkylamino, substituted silyl, an RNA cleaving group, a reporter group, an intercalator, a group for improving the pharmacokinetic properties of an oligonucleotide, or a group for improving the pharmacodynamic properties of an oligonucleotide, and other substituents having similar properties. Similar modifications may also be made at other positions on the sugar, particularly the 3' position of the sugar on the 3' terminal nucleotide or in 2'-5' linked oligonucleotides and the 5' position of 5' terminal nucleotide. Modified sugars can also include those that contain modifications at the bridging ring oxygen, such as $CH_2$ and S. Nucleotide sugar analogs can also have sugar mimetics, such as cyclobutyl moieties in place of the pentofuranosyl sugar.

Nucleotide analogs can also be modified at the phosphate moiety. Modified phosphate moieties include, but are not limited to, those that can be modified so that the linkage between two nucleotides contains a phosphorothioate, chiral phosphorothioate, phosphorodithioate, phosphotriester, aminoalkylphosphotriester, methyl and other alkyl phosphonates including 3'-alkylene phosphonate and chiral phosphonates, phosphinates, phosphoramidates including 3'-amino phosphoramidate and aminoalkylphosphoramidates, thionophosphoramidates, thionoalkylphosphonates, thionoalkylphosphotriesters, and boranophosphates. These phosphate or modified phosphate linkage between two nucleotides can be through a 3'-5' linkage or a 2'-5' linkage, and the linkage can contain inverted polarity such as 3'-5' to 5'-3' or 2'-5' to 5'-2'. Various salts, mixed salts, and free acid forms are also included. Nucleotide substitutes also include peptide nucleic acids (PNAs).

In some embodiments, the antisense nucleic acid molecules are gapmers, whereby the first one to seven nucleotides at the 5' and 3' ends each have 2'-methoxyethyl (2'-MOE) modifications. In some embodiments, the first five nucleotides at the 5' and 3' ends each have 2'-MOE modifications. In some embodiments, the first one to seven nucleotides at the 5' and 3' ends are RNA nucleotides. In some embodiments, the first five nucleotides at the 5' and 3' ends are RNA nucleotides. In some embodiments, each of the backbone linkages between the nucleotides is a phosphorothioate linkage.

In some embodiments, the siRNA molecules have termini modifications. In some embodiments, the 5' end of the antisense strand is phosphorylated. In some embodiments, 5'-phosphate analogs that cannot be hydrolyzed, such as 5'-(E)-vinyl-phosphonate are used.

In some embodiments, the siRNA molecules have backbone modifications. In some embodiments, the modified phosphodiester groups that link consecutive ribose nucleosides have been shown to enhance the stability and in vivo bioavailability of siRNAs The non-ester groups (—OH, =O) of the phosphodiester linkage can be replaced with sulfur, boron, or acetate to give phosphorothioate, boranophosphate, and phosphonoacetate linkages. In addition, substituting the phosphodiester group with a phosphotriester can facilitate cellular uptake of siRNAs and retention on serum components by eliminating their negative charge. In some embodiments, the siRNA molecules have sugar modifications. In some embodiments, the sugars are deprotonated (reaction catalyzed by exo- and endonucleases) whereby the 2'-hydroxyl can act as a nucleophile and attack the adjacent phosphorous in the phosphodiester bond. Such alternatives include 2'-O-methyl, 2'-O-methoxyethyl, and 2'-fluoro modifications.

In some embodiments, the siRNA molecules have base modifications. In some embodiments, the bases can be substituted with modified bases such as pseudouridine, 5'-methylcytidine, N6-methyladenosine, inosine, and N7-methylguanosine.

In some embodiments, the siRNA molecules are conjugated to lipids. Lipids can be conjugated to the 5' or 3' termini of siRNA to improve their in vivo bioavailability by allowing them to associate with serum lipoproteins. Representative lipids include, but are not limited to, cholesterol and vitamin E, and fatty acids, such as palmitate and tocopherol.

In some embodiments, a representative siRNA has the following formula:
Sense: mN*mN*/i2FN/mN/i2FN/mN/i2FN/mN/i2FN/mN/i2FN/mN/i2FN/mN/i2FN/mN/i2FN/*mN*/32FN/
Antisense: /52FN/*/i2FN/*mN/i2FN/mN/i2FN/mN/i2FN/mN/i2FN/mN/i2FN/mN/i2FN/mN/i2FN/mN/i2FN/mN*N*N
wherein: "N" is the base; "2F" is a 2'-F modification; "m" is a 2'-O-methyl modification, "I" is an internal base; and "*" is a phosphorothioate backbone linkage.

The present disclosure also provides vectors comprising any one or more of the inhibitory nucleic acid molecules disclosed herein. In some embodiments, the vectors comprise any one or more of the inhibitory nucleic acid molecules disclosed herein and a heterologous nucleic acid. The vectors can be viral or nonviral vectors capable of transporting a nucleic acid molecule. In some embodiments, the vector is a plasmid or cosmid (such as, for example, a circular double-stranded DNA into which additional DNA segments can be ligated). In some embodiments, the vector is a viral vector, wherein additional DNA segments can be ligated into the viral genome. Expression vectors include, but are not limited to, plasmids, cosmids, retroviruses, adenoviruses, adeno-associated viruses (AAV), plant viruses such as cauliflower mosaic virus and tobacco mosaic virus, yeast artificial chromosomes (YACs), Epstein-Barr (EBV)-derived episomes, and other expression vectors known in the art.

The present disclosure also provides compositions comprising any one or more of the inhibitory nucleic acid molecules disclosed herein. In some embodiments, the composition is a pharmaceutical composition. In some embodiments, the compositions comprise a carrier and/or excipient. Examples of carriers include, but are not limited to, poly (lactic acid) (PLA) microspheres, poly(D,L-lactic-coglycolic-acid) (PLGA) microspheres, liposomes, micelles, inverse micelles, lipid cochleates, and lipid microtubules. A carrier may comprise a buffered salt solution such as PBS, HBSS, etc.

In some embodiments, the CIDEB inhibitor comprises a nuclease agent that induces one or more nicks or double-strand breaks at a recognition sequence(s) or a DNA-binding protein that binds to a recognition sequence within a CIDEB genomic nucleic acid molecule. The recognition sequence can be located within a coding region of the CIDEB gene, or within regulatory regions that influence the expression of the gene. A recognition sequence of the DNA-binding protein or nuclease agent can be located in an intron, an exon, a promoter, an enhancer, a regulatory region, or any non-protein coding region. The recognition sequence can include or be proximate to the start codon of the CIDEB gene. For example, the recognition sequence can be located about 10, about 20, about 30, about 40, about 50, about 100, about 200, about 300, about 400, about 500, or about 1,000 nucleotides from the start codon.

In some embodiments, the PNPLA3 inhibitor comprises a nuclease agent that induces one or more nicks or double-strand breaks at a recognition sequence(s) or a DNA-binding protein that binds to a recognition sequence within a PNPLA3 genomic nucleic acid molecule. The recognition sequence can be located within a coding region of the PNPLA3 gene, or within regulatory regions that influence the expression of the gene. A recognition sequence of the DNA-binding protein or nuclease agent can be located in an intron, an exon, a promoter, an enhancer, a regulatory region, or any non-protein coding region. The recognition sequence can include or be proximate to the start codon of the PNPLA3 gene. For example, the recognition sequence can be located about 10, about 20, about 30, about 40, about 50, about 100, about 200, about 300, about 400, about 500, or about 1,000 nucleotides from the start codon.

In some embodiments, the HSD17B13 inhibitor comprises a nuclease agent that induces one or more nicks or double-strand breaks at a recognition sequence(s) or a DNA-binding protein that binds to a recognition sequence within an HSD17B13 genomic nucleic acid molecule. The recognition sequence can be located within a coding region of the HSD17B13 gene, or within regulatory regions that influence the expression of the gene. A recognition sequence of the DNA-binding protein or nuclease agent can be located in an intron, an exon, a promoter, an enhancer, a regulatory region, or any non-protein coding region. The recognition sequence can include or be proximate to the start codon of the HSD17B13 gene. For example, the recognition sequence can be located about 10, about 20, about 30, about 40, about 50, about 100, about 200, about 300, about 400, about 500, or about 1,000 nucleotides from the start codon.

As another example, two or more nuclease agents can be used, each targeting a nuclease recognition sequence including or proximate to the start codon. As another example, two nuclease agents can be used, one targeting a nuclease recognition sequence including or proximate to the start codon, and one targeting a nuclease recognition sequence including or proximate to the stop codon, wherein cleavage by the nuclease agents can result in deletion of the coding region between the two nuclease recognition sequences. Any nuclease agent that induces a nick or double-strand break into a desired recognition sequence can be used in the methods and compositions disclosed herein. Any DNA-binding protein that binds to a desired recognition sequence can be used in the methods and compositions disclosed herein.

Suitable nuclease agents and DNA-binding proteins for use herein include, but are not limited to, zinc finger protein or zinc finger nuclease (ZFN) pair, Transcription Activator-Like Effector (TALE) protein or Transcription Activator-Like Effector Nuclease (TALEN), or Clustered Regularly Interspersed Short Palindromic Repeats (CRISPR)/CRISPR-associated (Cas) systems. The length of the recognition sequence can vary, and includes, for example, recognition sequences that are about 30-36 bp for a zinc finger protein or ZFN pair, about 15-18 bp for each ZFN, about 36 bp for a TALE protein or TALEN, and about 20 bp for a CRISPR/Cas guide RNA.

In some embodiments, CRISPR/Cas systems can be used to modify a CIDEB genomic nucleic acid molecule, a PNPLA3 genomic nucleic acid molecule, or an HSD17B13 genomic nucleic acid molecule within a cell. The methods and compositions disclosed herein can employ CRISPR-Cas systems by utilizing CRISPR complexes (comprising a guide RNA (gRNA) complexed with a Cas protein) for site-directed cleavage of CIDEB nucleic acid molecules, PNPLA3 nucleic acid molecules, or HSD17B13 nucleic acid molecules.

Cas proteins generally comprise at least one RNA recognition or binding domain that can interact with gRNAs. Cas proteins can also comprise nuclease domains (such as, for example, DNase or RNase domains), DNA binding domains, helicase domains, protein-protein interaction domains, dimerization domains, and other domains. Suitable Cas proteins include, for example, a wild type Cas9 protein and a wild type Cpf1 protein (such as, for example, FnCpf1). A Cas protein can have full cleavage activity to create a double-strand break in a CIDEB genomic nucleic acid molecule, a PNPLA3 genomic nucleic acid molecule, or an HSD17B13 genomic nucleic acid molecule, or it can be a nickase that creates a single-strand break in a CIDEB genomic nucleic acid molecule, a PNPLA3 genomic nucleic acid molecule, or an HSD17B13 genomic nucleic acid molecule. Additional examples of Cas proteins include, but are not limited to, Cas1, Cas1B, Cast, Cas3, Cas4, Cas5, Cas5e (CasD), Cas6, Cas6e, Cas6f, Cas7, Cas8a1, Cas8a2, Cas8b, Cas8c, Cas9 (Csn1 or Csx12), Cas10, Cas10d, Cas12a, CasF, CasG, CasH, Csy1, Csy2, Csy3, Cse1 (CasA), Cse2 (CasB), Cse3 (CasE), Cse4 (CasC), Csc1, Csc2, Csa5, Csn2, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx15, Csf1, Csf2, Csf3, Csf4, and Cu1966, and homologs or modified versions thereof. In some embodiments, a Cas system, such as Cas12a, can have multiple gRNAs encoded into a single crRNA. Cas proteins can also be operably linked to heterologous polypeptides as fusion proteins. For example, a Cas protein can be fused to a cleavage domain, an epigenetic modification domain, a transcriptional activation domain, or a transcriptional repressor domain. Cas proteins can be provided in any form. For example, a Cas protein can be provided in the form of a protein, such as a Cas protein complexed with a gRNA. Alternately, a Cas protein can be provided in the form of a nucleic acid molecule encoding the Cas protein, such as an RNA or DNA.

In some embodiments, targeted genetic modifications of CIDEB genomic nucleic acid molecules can be generated by contacting a cell with a Cas protein and one or more gRNAs that hybridize to one or more gRNA recognition sequences within a target genomic locus in the CIDEB genomic nucleic acid molecule. For example, a gRNA recognition sequence can be located within a region of SEQ ID NO:1. For example, the gRNA recognition sequence can be located from about 1000, from about 500, from about 400, from about 300, from about 200, from about 100, from about 50, from about 45, from about 40, from about 35, from about 30, from about 25, from about 20, from about 15, from about 10, or from about 5 nucleotides of a position corresponding to any one or more of positions: 14:24305635, 14:24305641, 14:24305650, 14:24305657, 14:24305662, 14:24305667, 14:24305671, 14:24305701, 14:24305709, 14:24305718, 14:24305721, 14:24305728, 14:24305743, 14:24305948, 14:24305966, 14:24305974, 14:24305980, 14:24305988, 14:24306014, 14:24306034, 14:24306041, 14:24306044, 14:24306047, 14:24306051, 14:24306064, 14:24306074, 14:24306077, 14:24306082, 14:24306083, 14:24306095, 14:24306122, 14:24306134, 14:24306373, 14:24306379, 14:24306382, 14:24306383, 14:24306426, 14:24306437, 14:24306439, 14:24306442, 14:24306444, 14:24306457, 14:24306463, 14:24306469, 14:24306480, 14:24306486, 14:24306504, 14:24306519, 14:24307382, 14:24307405, 14:24307417, 14:24307421, 14:24307441, 14:24307444, 14:24307444, 14:24307450, 14:24307461, 14:24307469, 14:24307474, 14:24307475, 14:24307833, 14:24307851, 14:24306426, 14:24307849, 14:24307448, 14:24305671, 14:24305663, 14:24305686, 14:24307829, 14:24307818, 14:24307856, 14:24306423, 14:24306061, 14:24307390, 14:24306382, 14:24306373, 14:24305733, 14:24307858, 14:24306387, 14:24305637, 14:24306062, 14:24307853, 14:24307450, 14:24306052, 14:24305673, 14:24306043, 14:24307834, 14:24306417, 14:24307451, 14:24307436, 14:24305953, 14:24306489, 14:24307441, 14:24306375, 14:24305657, 14:24306427, 14:24306524, 14:24307516, 14:24307840, 14:24307501, 14:24305968, 14:24305986, 14:24307441, 14:24307459, 14:24306017, 14:24307424, 14:24306072, 14:24307423, 14:24307450, 14:24306420, 14:24307454, 14:24305653, 14:24307442, 14:24306002, 14:24306076, 14:24305664, 14:24305961, 14:24305706, 14:24305946, 14:24306455, 14:24307468, 14:24307825, 14:24306110, 14:24305710, 14:24307483, 14:24306459, 14:24305754, 14:24305650, 14:24305691, 14:24306508, 14:24306039, 14:24306139, 14:24306391, 14:24306373, 14:24307498, 14:24307451, 14:24306138, 14:24307453, 14:24305692, 14:24305683, 14:24307484, 14:24307385, 14:24306519, 14:24307839, 14:24305965, 14:24305988, 14:24306087, 14:24307439, 14:24307477, 14:24306436, 14:24306507, 14:24307397, 14:24307495, 14:24306034, 14:24306013, 14:24307381, 14:24306383, 14:24305638, 14:24307420, 14:24306020, 14:24306470, 14:24307435, 14:24306469, 14:24306451, 14:24306403, 14:24307515, 14:24307489, 14:24307414, 14:24306483, 14:24305755, 14:24305766, 14:24306064, 14:24307516, 14:24305766, 14:24306489, 14:24306097, 14:24305763, 14:24307447, 14:24307402, 14:24305972, 14:24306423, 14:24305974, 14:24307411, 14:24306121, 14:24307516, 14:24306424, 14:24306039, 14:24307853, 14:24306388, 14:24305990, 14:24307822, 14:24305640, 14:24307418, 14:24305758, 14:24306131, 14:24305953, 14:24305730, 14:24306418, 14:24306059, 14:24307842, 14:24307837, 14:24306095, 14:24306109, 14:24307822, 14:24306077, 14:24307824, 14:24306080, 14:24305649, 14:24306433, 14:24306420, 14:24305658, 14:24306472, 14:24307412, 14:24306062, 14:24306044, 14:24306047, 14:24306126, 14:24306449, 14:24307391, or 14:24307857 (according to GRCh38/hg38 human genome assembly coordinates). The gRNA recognition sequence can include or be proximate to the start codon of a CIDEB genomic nucleic acid molecule or the stop codon of a CIDEB genomic nucleic acid molecule. For example, the gRNA recognition sequence can be located from about 10, from about 20, from about 30, from about 40, from about 50, from about 100, from about 200, from about 300, from about 400, from about 500, or from about 1,000 nucleotides of the start codon or the stop codon.

The gRNA recognition sequences within a target genomic locus in a CIDEB genomic nucleic acid molecule can be located near a Protospacer Adjacent Motif (PAM) sequence, which is a 2-6 base pair DNA sequence immediately following the DNA sequence targeted by the Cas9 nuclease. The canonical PAM is the sequence 5'-NGG-3' where "N" is any nucleobase followed by two guanine ("G") nucleobases. gRNAs can transport Cas9 to anywhere in the genome for gene editing, but no editing can occur at any site other than one at which Cas9 recognizes PAM. In addition, 5'-NGA-3' can be a highly efficient non-canonical PAM for human cells. Generally, the PAM is about 2-6 nucleotides downstream of the DNA sequence targeted by the gRNA. The PAM can flank the gRNA recognition sequence. In some embodiments, the gRNA recognition sequence can be flanked on the 3' end by the PAM. In some embodiments, the gRNA recognition sequence can be flanked on the 5' end by the PAM. For example, the cleavage site of Cas proteins can be about 1 to about 10, about 2 to about 5 base pairs, or three base pairs upstream or downstream of the PAM sequence. In some embodiments (such as when Cas9 from *S. pyogenes* or a closely related Cas9 is used), the PAM sequence of the non-complementary strand can be 5'-NGG-3', where N is any DNA nucleotide and is immediately 3' of the gRNA recognition sequence of the non-complementary strand of the target DNA. As such, the PAM sequence of the complementary strand would be 5'-CCN-3', where N is any DNA nucleotide and is immediately 5' of the gRNA recognition sequence of the complementary strand of the target DNA.

A gRNA is an RNA molecule that binds to a Cas protein and targets the Cas protein to a specific location within a CIDEB genomic nucleic acid molecule. An exemplary gRNA is a gRNA effective to direct a Cas enzyme to bind to or cleave a CIDEB genomic nucleic acid molecule, wherein the gRNA comprises a DNA-targeting segment that hybridizes to a gRNA recognition sequence within the CIDEB genomic nucleic acid molecule that includes or is proximate to a position corresponding to positions: 14:24305635, 14:24305641, 14:24305650, 14:24305657, 14:24305662, 14:24305667, 14:24305671, 14:24305701, 14:24305709, 14:24305718, 14:24305721, 14:24305728, 14:24305743, 14:24305948, 14:24305966, 14:24305974, 14:24305980, 14:24305988, 14:24306014, 14:24306034, 14:24306041, 14:24306044, 14:24306047, 14:24306051, 14:24306064, 14:24306074, 14:24306077, 14:24306082, 14:24306083, 14:24306095, 14:24306122, 14:24306134, 14:24306373, 14:24306379, 14:24306382, 14:24306383, 14:24306426, 14:24306437, 14:24306439, 14:24306442, 14:24306444, 14:24306457, 14:24306463, 14:24306469, 14:24306480, 14:24306486, 14:24306504, 14:24306519, 14:24307382, 14:24307405, 14:24307417, 14:24307421, 14:24307441, 14:24307444, 14:24307444, 14:24307450, 14:24307461, 14:24307469, 14:24307474, 14:24307475, 14:24307833, 14:24307851, 14:24306426, 14:24307849, 14:24307448, 14:24305663, 14:24305686, 14:24307829, 14:24307818, 14:24307856, 14:24306423, 14:24306061, 14:24307390, 14:24306382, 14:24306373, 14:24305733, 14:24307858, 14:24306387, 14:24305637, 14:24306062, 14:24307853, 14:24307450, 14:24306052, 14:24305673, 14:24306043, 14:24307834, 14:24306417, 14:24307451, 14:24307436, 14:24305953, 14:24306489, 14:24307441, 14:24306375, 14:24305657, 14:24306427, 14:24306524, 14:24307516, 14:24307840, 14:24307501, 14:24305968, 14:24305986, 14:24307441, 14:24307459, 14:24306017, 14:24307424, 14:24306072, 14:24307423, 14:24307450, 14:24306420, 14:24307454, 14:24305653, 14:24307442, 14:24306002, 14:24306076, 14:24305664, 14:24305961, 14:24305706, 14:24305946, 14:24306455, 14:24307468, 14:24307825, 14:24306110, 14:24305710, 14:24307483, 14:24306459, 14:24305754, 14:24305650, 14:24305691, 14:24306508, 14:24306039, 14:24306139, 14:24306391, 14:24306373, 14:24307498, 14:24307415, 14:24306138, 14:24307453, 14:24305692, 14:24305683, 14:24307484, 14:24307385, 14:24306519, 14:24307839, 14:24305965, 14:24305988, 14:24306087, 14:24307439, 14:24307477, 14:24306436, 14:24306507, 14:24307397, 14:24307495, 14:24306034, 14:24306013, 14:24307381, 14:24306383, 14:24305638, 14:24307420, 14:24306020, 14:24306470, 14:24307435, 14:24306469, 14:24306451, 14:24306403, 14:24307515, 14:24307489, 14:24307414, 14:24306483, 14:24305755, 14:24305766, 14:24306064, 14:24307516, 14:24305766, 14:24306489, 14:24306097, 14:24305763, 14:24307447, 14:24307402, 14:24305972, 14:24306423, 14:24305974, 14:24307411, 14:24306121, 14:24307516, 14:24306424, 14:24306039, 14:24307853, 14:24306388, 14:24305990, 14:24307822, 14:24305640, 14:24307418, 14:24305758, 14:24306131, 14:24305953, 14:24305730, 14:24306418, 14:24306059, 14:24307842, 14:24307837, 14:24306095, 14:24306109, 14:24307822, 14:24306077, 14:24307824, 14:24306080, 14:24305649, 14:24306433, 14:24306420, 14:24305658, 14:24306472, 14:24307412, 14:24306062, 14:24306044, 14:24306047, 14:24306126, 14:24306449, 14:24307391, or 14:24307857 (according to GRCh38/hg38 human genome assembly coordinates). For example, a gRNA can be selected such that it hybridizes to a gRNA recognition sequence that is located from about 5, from about 10, from about 15, from about 20, from about 25, from about 30, from about 35, from about 40, from about 45, from about 50, from about 100, from about 200, from about 300, from about 400, from about 500, or from about 1,000 nucleotides of a position corresponding to: 14:24305635, 14:24305641, 14:24305650, 14:24305657, 14:24305662, 14:24305667, 14:24305671, 14:24305701, 14:24305709, 14:24305718, 14:24305721, 14:24305728, 14:24305743, 14:24305948, 14:24305966, 14:24305974, 14:24305980, 14:24305988, 14:24306014, 14:24306034, 14:24306041, 14:24306044, 14:24306047, 14:24306051, 14:24306064, 14:24306074, 14:24306077, 14:24306082, 14:24306083, 14:24306095, 14:24306122, 14:24306134, 14:24306373, 14:24306379, 14:24306382, 14:24306383, 14:24306426, 14:24306437, 14:24306439, 14:24306442, 14:24306444, 14:24306457, 14:24306463, 14:24306469, 14:24306480, 14:24306486, 14:24306504, 14:24306519, 14:24307382, 14:24307405, 14:24307417, 14:24307421, 14:24307441, 14:24307444, 14:24307444, 14:24307450, 14:24307461, 14:24307469, 14:24307474, 14:24307475, 14:24307833, 14:24307851, 14:24306426, 14:24307849, 14:24307448, 14:24305663, 14:24305686, 14:24307829, 14:24307818, 14:24307856, 14:24306423, 14:24306061, 14:24307390, 14:24306382, 14:24306373, 14:24305733, 14:24307858, 14:24306387, 14:24305637, 14:24306062, 14:24307853, 14:24307450, 14:24306052, 14:24305673, 14:24306043, 14:24307834, 14:24306417, 14:24307451, 14:24307436, 14:24305953, 14:24306489, 14:24307441, 14:24306375, 14:24305657, 14:24306427, 14:24306524, 14:24307516, 14:24307840, 14:24307501, 14:24305968, 14:24305986, 14:24307441, 14:24307459, 14:24306017, 14:24307424, 14:24306072, 14:24307423, 14:24307450, 14:24306420, 14:24307454, 14:24305653, 14:24307442, 14:24306002, 14:24306076, 14:24305664, 14:24305961, 14:24305706, 14:24305946, 14:24306455, 14:24307468, 14:24307825, 14:24306110, 14:24305710, 14:24307483, 14:24306459, 14:24305754, 14:24305650, 14:24305691, 14:24306508, 14:24306039, 14:24306139, 14:24306391, 14:24306373, 14:24307498, 14:24307415, 14:24306138, 14:24307453, 14:24305692, 14:24305683, 14:24307484, 14:24307385, 14:24306519, 14:24307839, 14:24305965, 14:24305988, 14:24306087, 14:24307439, 14:24307477, 14:24306436, 14:24306507, 14:24307397, 14:24307495, 14:24306034, 14:24306013, 14:24307381, 14:24306383, 14:24305638, 14:24307420, 14:24306020, 14:24306470, 14:24307435, 14:24306469, 14:24306451, 14:24306403, 14:24307515, 14:24307489, 14:24307414, 14:24306483, 14:24305755, 14:24305766, 14:24306064, 14:24307516, 14:24305766, 14:24306489, 14:24306097, 14:24305763, 14:24307447, 14:24307402, 14:24305972, 14:24306423, 14:24305974, 14:24307411, 14:24306121, 14:24307516, 14:24306424, 14:24306039, 14:24307853, 14:24306388, 14:24305990, 14:24307822, 14:24305640, 14:24307418, 14:24305758, 14:24306131, 14:24305953, 14:24305730, 14:24306418, 14:24306059, 14:24307842, 14:24307837, 14:24306095, 14:24306109, 14:24307822, 14:24306077, 14:24307824, 14:24306080, 14:24305649, 14:24306433, 14:24306420, 14:24305658, 14:24306472, 14:24307412, 14:24306062, 14:24306044, 14:24306047, 14:24306126, 14:24306449, 14:24307391, or 14:24307857 (according to GRCh38/hg38 human genome assembly coordinates). Other exemplary gRNAs comprise a DNA-targeting segment that hybridizes to a gRNA recognition sequence present within a CIDEB genomic nucleic acid molecule that includes or is proximate to the start codon or the stop codon. For example, a gRNA can be selected such that it hybridizes to a gRNA recognition sequence that is located from about 5, from about 10, from about 15, from about 20, from about 25, from about 30, from about 35, from about 40, from about 45, from about 50, from about 100, from about 200, from about 300, from about 400, from about 500, or from about 1,000 nucleotides of the start codon or located from about 5, from about 10, from about 15, from about 20, from about 25, from about 30, from about 35, from about 40, from about 45, from about 50, from about 100, from about 200, from about 300, from about 400, from about 500, or from about 1,000 nucleotides of the stop codon. Suitable gRNAs can comprise from about 17 to about 25 nucleotides, from about 17 to about 23 nucleotides, from about 18 to about 22 nucleotides, or from about 19 to about 21 nucleotides. In some embodiments, the gRNAs can comprise 20 nucleotides.

Examples of suitable gRNA recognition sequences located within the human CIDEB reference gene are set forth in Table 14 as SEQ ID NOs:25-37.

TABLE 14

Guide RNA Recognition Sequences Near CIDEB Variation(s)

| Strand | gRNA Recognition Sequence | SEQ ID NO: |
|---|---|---|
| + | AGCTGAGAGGTACTCCATGGTGG | 25 |
| + | CAGAGCTGAGAGGTACTCCATGG | 26 |
| + | GTCACCTGAGTAAGTCACTGGGG | 27 |
| + | AGTCACCTGAGTAAGTCACTGGG | 28 |
| + | CAGTCACCTGAGTAAGTCACTGG | 29 |
| + | GCTTATATTAGATACTGACCTGG | 30 |
| − | GTCAGTATCTAATATAAGCTCGG | 31 |
| − | ATATAAGCTCGGAGTTTGGACGG | 32 |
| + | CAGACACGGAAAGGTCGCTGGGG | 33 |
| + | TTGTGATCACAGACACGGAAAGG | 34 |
| − | TCCGTGTCTGTGATCACAAGCGG | 35 |
| − | TCCGCTTGTGATCACAGACACGG | 36 |
| + | AGCTGTCAGGCCTTTCCGGATGG | 37 |

The Cas protein and the gRNA form a complex, and the Cas protein cleaves the target CIDEB genomic nucleic acid molecule. The Cas protein can cleave the nucleic acid molecule at a site within or outside of the nucleic acid sequence present in the target CIDEB, genomic nucleic acid sequence to which the DNA-targeting segment of a gRNA will bind. For example, formation of a CRISPR complex (comprising a gRNA hybridized to a gRNA recognition sequence and complexed with a Cas protein) can result in cleavage of one or both strands in or near (such as, for example, within 1, 2, 3, 4, 5, 6, 7, 8, 9, 10, 20, 50, or more base pairs from) the nucleic acid sequence present in the CIDEB genomic nucleic acid molecule to which a DNA-targeting segment of a gRNA will bind.

Such methods can result, for example, in a CIDEB genomic nucleic acid molecule in which a region of SEQ ID NO:1 is disrupted, the start codon is disrupted, the stop codon is disrupted, or the coding sequence is disrupted or deleted. Optionally, the cell can be further contacted with one or more additional gRNAs that hybridize to additional gRNA recognition sequences within the target genomic locus in the CIDEB genomic nucleic acid molecule. By contacting the cell with one or more additional gRNAs (such as, for example, a second gRNA that hybridizes to a second gRNA recognition sequence), cleavage by the Cas protein can create two or more double-strand breaks or two or more single-strand breaks.

In some embodiments, targeted genetic modifications of PNPLA3 genomic nucleic acid molecules can be generated by contacting a cell with a Cas protein and one or more gRNAs that hybridize to one or more gRNA recognition sequences within a target genomic locus in the PHPLA3 genomic nucleic acid molecule. For example, a gRNA recognition sequence can be located within a region of SEQ ID NO:43. For example, the gRNA recognition sequence can be located from about 1000, from about 500, from about 400, from about 300, from about 200, from about 100, from about 50, from about 45, from about 40, from about 35, from about 30, from about 25, from about 20, from about 15, from about 10, or from about 5 nucleotides of a position corresponding to position 5109 according to SEQ ID NO:43. Other exemplary gRNAs comprise a DNA-targeting segment that hybridizes to a gRNA recognition sequence present within a PNPLA3 genomic nucleic acid molecule that includes or is proximate to the start codon or the stop codon. For example, a gRNA can be selected such that it hybridizes to a gRNA recognition sequence that is located about 5, about 10, about 15, about 20, about 25, about 30, about 35, about 40, about 45, about 50, about 100, about 200, about 300, about 400, about 500, or about 1,000 nucleotides from the start codon or located about 5, about 10, about 15, about 20, about 25, about 30, about 35, about 40, about 45, about 50, about 100, about 200, about 300, about 400, about 500, or about 1,000 nucleotides from the stop codon. Suitable gRNAs can comprise from about 17 to about 25 nucleotides, from about 17 to about 23 nucleotides, from about 18 to about 22 nucleotides, or from about 19 to about 21 nucleotides. In some embodiments, the gRNAs comprise 20 nucleotides.

Examples of suitable gRNA recognition sequences located within the PNPLA3 reference gene are set forth in Table 15 as SEQ ID NOs:75-94.

TABLE 15

PNPLA3 Guide RNA Recognition Sequences

| Strand | gRNA Recognition Sequence | SEQ ID NO: |
|---|---|---|
| + | TCGGTCCAAAGACGAAGTCG | 75 |
| − | CCTTCCGCACAAGATCTGAG | 76 |
| − | TGTCGTACTCCCCATAGAAG | 77 |
| − | ATGCATCCAAATATCCTCGA | 78 |
| − | ACAACATGCGCGCGTCGCGG | 79 |
| − | GGCATTTGCAGAGACCCTGT | 80 |
| + | TTAAGCAAGTTCCTCCGACA | 81 |
| − | GCGTCCCCAGACGCACCCAG | 82 |
| − | CTCAGGATCCATCCCTTCTG | 83 |
| + | TCTTACCAGAGTGTCTGATG | 84 |
| − | AAGCTCTCGAGAGAAGGTAG | 85 |
| − | GCAGAGGCGTAGACTGAGCT | 86 |
| + | TAAAAGCGATATGTGGATGG | 87 |
| − | CGAACAACATGCGCGCGTCG | 88 |
| + | CTGGGAGAGATATGCCTTCG | 89 |
| + | AGGTCCTCTCAGATCTTGTG | 90 |
| − | CCAACTCACCTTGAGATCCG | 91 |
| − | GGAGATGAGCTGGTGGACAT | 92 |

TABLE 15-continued

PNPLA3 Guide RNA Recognition Sequences

| Strand | gRNA Recognition Sequence | SEQ ID NO: |
|---|---|---|
| + | TCAGTCTACGCCTCTGCACA | 93 |
| − | TCCAGGATGCTCTCATCCCA | 94 |

The Cas protein and the gRNA form a complex, and the Cas protein cleaves the target PNPLA3 genomic nucleic acid molecule. The Cas protein can cleave the nucleic acid molecule at a site within or outside of the nucleic acid sequence present in the target PNPLA3, genomic nucleic acid molecule to which the DNA-targeting segment of a gRNA will bind. For example, formation of a CRISPR complex (comprising a gRNA hybridized to a gRNA recognition sequence and complexed with a Cas protein) can result in cleavage of one or both strands in or near (such as, for example, within 1, 2, 3, 4, 5, 6, 7, 8, 9, 10, 20, 50, or more base pairs from) the nucleic acid sequence present in the PNPLA3 genomic nucleic acid molecule to which a DNA-targeting segment of a gRNA will bind.

Such methods can result, for example, in a PNPLA3 genomic nucleic acid molecule in which a region of SEQ ID NO:43 is disrupted, the start codon is disrupted, the stop codon is disrupted, or the coding sequence is disrupted or deleted. Optionally, the cell can be further contacted with one or more additional gRNAs that hybridize to additional gRNA recognition sequences within the target genomic locus in the PNPLA3 genomic nucleic acid molecule. By contacting the cell with one or more additional gRNAs (such as, for example, a second gRNA that hybridizes to a second gRNA recognition sequence), cleavage by the Cas protein can create two or more double-strand breaks or two or more single-strand breaks.

In some embodiments, targeted genetic modifications of HSD17B13 genomic nucleic acid molecules can be generated by contacting a cell with a Cas protein and one or more gRNAs that hybridize to one or more gRNA recognition sequences within a target genomic locus in the PHPLA3 genomic nucleic acid molecule. For example, a gRNA recognition sequence can a DNA-targeting segment that hybridizes to a gRNA recognition sequence present within an HSD17B13 genomic nucleic acid molecule that includes or is proximate to the start codon or the stop codon. For example, a gRNA can be selected such that it hybridizes to a gRNA recognition sequence that is located about 5, about 10, about 15, about 20, about 25, about 30, about 35, about 40, about 45, about 50, about 100, about 200, about 300, about 400, about 500, or about 1,000 nucleotides from the start codon or located about 5, about 10, about 15, about 20, about 25, about 30, about 35, about 40, about 45, about 50, about 100, about 200, about 300, about 400, about 500, or about 1,000 nucleotides from the stop codon. Suitable gRNAs can comprise from about 17 to about 25 nucleotides, from about 17 to about 23 nucleotides, from about 18 to about 22 nucleotides, or from about 19 to about 21 nucleotides. In some embodiments, the gRNAs comprise 20 nucleotides.

Examples of suitable gRNA recognition sequences located within the HSD17B13 reference gene are set forth in Table 16 as SEQ ID NOs:95-114.

TABLE 16

HSD17B13 Guide RNA Recognition Sequences

| Strand | gRNA Recognition Sequence | SEQ ID NO: |
|---|---|---|
| − | AGTGGGTGATGTAACAATCG | 95 |
| + | TGAGGTAAGGAATCCCTTCG | 96 |
| + | ACCTCTGTGAAAGCCAACAG | 97 |
| − | TTCCTAATTACAGCGCGGTG | 98 |
| − | ACATTTGAGGTCAACATCCT | 99 |
| + | CACTCACCCAAAAATGTCCT | 100 |
| − | CAATCGTGGTGAATAATGCT | 101 |
| + | CTTCACCAACGACTCCAAGT | 102 |
| + | ATACTTACCAATATGGGATG | 103 |
| − | CGTCACTGCGCATGCGTATG | 104 |
| − | AGCCGATCTTCTCAGCACCA | 105 |
| − | ACAGAGCATATTGGTTCTGT | 106 |
| − | GAGCTGGGCATGGAATAGGC | 107 |
| + | CTGAAGCCACTGTGACGATG | 108 |
| − | GCAGCTGAGTGCCGAAAACT | 109 |
| − | AGCACTTCTTCCATCGATGA | 110 |
| − | CTTCAGTGTGCGGCCACGAA | 111 |
| − | AGAGGAGAAAATCTGTGGCT | 112 |
| − | TCCTCAGAGGAGAAAATCTG | 113 |
| + | GATGTTGACCTCAAATGTCT | 114 |

The Cas protein and the gRNA form a complex, and the Cas protein cleaves the target HSD17B13 genomic nucleic acid molecule. The Cas protein can cleave the nucleic acid molecule at a site within or outside of the nucleic acid sequence present in the target HSD17B13, genomic nucleic acid molecule to which the DNA-targeting segment of a gRNA will bind. For example, formation of a CRISPR complex (comprising a gRNA hybridized to a gRNA recognition sequence and complexed with a Cas protein) can result in cleavage of one or both strands in or near (such as, for example, within 1, 2, 3, 4, 5, 6, 7, 8, 9, 10, 20, 50, or more base pairs from) the nucleic acid sequence present in the HSD17B13 genomic nucleic acid molecule to which a DNA-targeting segment of a gRNA will bind.

Such methods can also result, for example, in an HSD17B13 genomic nucleic acid molecule in which a region of SEQ ID NO:52 is disrupted, the start codon is disrupted, the stop codon is disrupted, or the coding sequence is disrupted or deleted. Optionally, the cell can be further contacted with one or more additional gRNAs that hybridize to additional gRNA recognition sequences within the target genomic locus in the HSD17B13 genomic nucleic acid molecule. By contacting the cell with one or more additional gRNAs (such as, for example, a second gRNA that hybridizes to a second gRNA recognition sequence), cleavage by the Cas protein can create two or more double-strand breaks or two or more single-strand breaks.

In some embodiments, the CIDEB inhibitor is a small molecule. In some embodiments, the CIDEB inhibitor is an antibody. In some embodiments, the CIDEB inhibitor comprises an inhibitory nucleic acid molecule, such as, for example an antisense nucleic acid molecule, an siRNA, or an shRNA.

In some embodiments, the PNPLA3 inhibitor is a small molecule. In some embodiments, the PNPLA3 inhibitor is an antibody. In some embodiments, the PNPLA3 inhibitor comprises an inhibitory nucleic acid molecule, such as, for example an antisense nucleic acid molecule, an siRNA, or an shRNA. An exemplary PNPLA3 inhibitor is AZD2693.

In some embodiments, the HSD17B13 inhibitor is a small molecule. Numerous HSD17B13 inhibitors are described in, for example, PCT Publications WO2019/183329, WO2019/183164, and WO2020/061177. In some embodiments, the HSD17B13 inhibitor is an antibody. In some embodiments, the HSD17B13 inhibitor comprises an inhibitory nucleic acid molecule, such as, for example an antisense nucleic acid molecule, an siRNA, or an shRNA. Additional examples of HSD17B13 inhibitors include, but are not limited to ARO-HSD or ALN-HSD.

In some embodiments, the dose of the CIDEB inhibitor can be reduced by about 10%, by about 20%, by about 30%, by about 40%, by about 50%, by about 60%, by about 70%, by about 80%, or by about 90% for subjects that are heterozygous for one or more CIDEB variant nucleic acid molecules compared to subjects that are CIDEB reference (who may receive a standard dosage amount). In some embodiments, the dose of the CIDEB inhibitor can be reduced by about 10%, by about 20%, by about 30%, by about 40%, or by about 50%. In addition, the dose of the CIDEB inhibitor in subjects that are heterozygous for one or more CIDEB variant nucleic acid molecules can be administered less frequently compared to subjects that are CIDEB reference. The dose can also be changed based on BMI, % liver fat, liver span, age, sex, etc.

In some embodiments, the dose of the PNPLA3 inhibitor can be increased by about 10%, by about 20%, by about 30%, by about 40%, by about 50%, by about 60%, by about 70%, by about 80%, or by about 90% for subjects that are heterozygous for one or more PNPLA3 variant nucleic acid molecules compared to subjects that are PNPLA3 reference (who may receive a standard dosage amount). In some embodiments, the dose of the PNPLA3 inhibitor can be increased by about 10%, by about 20%, by about 30%, by about 40%, or by about 50%. In addition, the dose of the PNPLA3 inhibitor in subjects that are heterozygous for one or more PNPLA3 variant nucleic acid molecules can be administered more frequently compared to subjects that are PNPLA3 reference.

In some embodiments, the dose of the HSD17B13 inhibitor can be reduced by about 10%, by about 20%, by about 30%, by about 40%, by about 50%, by about 60%, by about 70%, by about 80%, or by about 90% for subjects that are heterozygous for one or more HSD17B13 variant nucleic acid molecules compared to subjects that are HSD17B13 reference (who may receive a standard dosage amount). In some embodiments, the dose of the HSD17B13 inhibitor can be reduced by about 10%, by about 20%, by about 30%, by about 40%, or by about 50%. In addition, the dose of the HSD17B13 inhibitor in subjects that are heterozygous for one or more HSD17B13 variant nucleic acid molecules can be administered less frequently compared to subjects that are HSD17B13 reference.

In some embodiments, the methods further comprise detecting the presence or absence of a CIDEB variant nucleic acid molecule and/or a CIDEB predicted loss-of-function polypeptide in a biological sample from the subject.

In some embodiments, the CIDEB variant nucleic acid molecule is a genomic nucleic acid molecule. In some embodiments, the CIDEB variant nucleic acid molecule is an mRNA molecule. In some embodiments, the CIDEB variant nucleic acid molecule is a cDNA molecule produced from an mRNA molecule. In some embodiments, the CIDEB variant nucleic acid molecule is a missense variant, a splice-site variant, a stop-gain variant, a start-loss variant, a stop-loss variant, a frameshift variant, or an in-frame indel variant, or a variant that encodes a truncated or mutated CIDEB polypeptide. In some embodiments, the CIDEB variant nucleic acid molecule comprises 14:24305635:A: AGTAG, 14:24305641:A:C, 14:24305650:G:A, 14:24305657:C:A, 14:24305662:G:T, 14:24305667:T:C, 14:24305671:C:A, 14:24305671:C:G, 14:24305701:A:T, 14:24305709:C:T, 14:24305718:A:G, 14:24305721:T:C, 14:24305728:G:GGCCTT, 14:24305743:T:C, 14:24305948: T:C, 14:24305966:C:T, 14:24305974:T:C, 14:24305980: TCA:T, 14:24305988:C:T, 14:24306014:C:T, 14:24306034: A:C, 14:24306041:C:G, 14:24306044:G:A, 14:24306047: G:A, 14:24306051:T:G, 14:24306064:T:C, 14:24306074:A: G, 14:24306077:G:C, 14:24306082:A:G, 14:24306083:T:A, 14:24306095:G:A, 14:24306122:A:G, 14:24306134:C:G, 14:24306373:C:G, 14:24306379:T:C, 14:24306382:G:A, 14:24306383:G:T, 14:24306426:T:G, 14:24306437:C:G, 14:24306439:G:C, 14:24306442:A:G, 14:24306444:A:G, 14:24306457:C:T, 14:24306463:C:T, 14:24306469:C:T, 14:24306480:A:G, 14:24306486:A:C, 14:24306504:A:G, 14:24306519:A:G, 14:24307382:G:C, 14:24307405:A:G, 14:24307417:A:T, 14:24307421:T:A, 14:24307441:C:A, 14:24307444:A:C, 14:24307444:A:G, 14:24307450:C: CGCTG, 14:24307461:TG:T, 14:24307469:AG:A, 14:24307474:C:T, 14:24307475:A:G, 14:24307833:G:C, 14:24307851:T:TAC, 14:24306426:T:C, 14:24307849:G:C, 14:24307448:G:T, 14:24305671:C:T, 14:24305663:C:T, 14:24305686:C:G, 14:24307829:A:C, 14:24307818:CT-GAG:C, 14:24307856:C:T, 14:24306423:T:C, 14:24306061:AC:A, 14:24307390:C:T, 14:24306382:G:T, 14:24306373:C:T, 14:24305733:T:C, 14:24307858:T:C, 14:24306387:C:T, 14:24305637:T:C, 14:24306062:C:T, 14:24307853:C:G, 14:24307450:C:G, 14:24306052:TG:T, 14:24305673:G:A, 14:24306043:C:T, 14:24307834:G:A, 14:24306417:C:T, 14:24307451:G:A, 14:24307436:A:C, 14:24305953:ACTTT:A, 14:24306489:G:T, 14:24307441: C:T, 14:24306375:C:T, 14:24305657:C:G, 14:24306427:C: T, 14:24306524:C:T, 14:24307516:C:A, 14:24307840:G:C, 14:24307501:A:G, 14:24305968:A:C, 14:24305986:C:T, 14:24307441:C:G, 14:24307459:G:T, 14:24306017:T:A, 14:24307424:G:A, 14:24306072:G:T, 14:24307423:C:T, 14:24307450:C:T, 14:24306420:G:A, 14:24307454:G:A, 14:24305653:C:T, 14:24307442:G:A, 14:24306002:C:T, 14:24306076:C:T, 14:24305664:C:T, 14:24305961:TG:T, 14:24305706:A:G, 14:24305946:C:T, 14:24306455:G:C, 14:24307468:G:A, 14:24307825:A:C, 14:24306110:G:A, 14:24305710:C:T, 14:24307483:C:T, 14:24306459:A:G, 14:24305754:C:T, 14:24305650:G:C, 14:24305691:C:T, 14:24306508:G:C, 14:24306039:G:T, 14:24306139:T:C, 14:24306391:T:C, 14:24306373:C:A, 14:24307498:C:T, 14:24307415:G:A, 14:24306138:CTG:C, 14:24307453:T:C, 14:24305692:G:A, 14:24305683:C:G, 14:24307484:G:A, 14:24307385:C:T, 14:24306519:A:T, 14:24307839:A:C, 14:24305965:C:T, 14:24305988:CAT:C, 14:24306087:C:G, 14:24307439:C:T, 14:24307477:A:C, 14:24306436:G:T, 14:24306507:A:G, 14:24307397:C:T, 14:24307495:G:A, 14:24306034:A:T, 14:24306013:G:A, 14:24307381:A:G, 14:24306383:G:C, 14:24305638:A:G, 14:24307420:G:A, 14:24306020:C:T, 14:24306470:A:C, 14:24307435:C:T, 14:24306469:C:G, 14:24306451:C:T, 14:24306403:G:A, 14:24307515:C:G, 14:24307489:A:G, 14:24307414:C:T, 14:24306483:A:G, 14:24305755:G:A, 14:24305766:C:T, 14:24306064:T:G, 14:24307516:C:G, 14:24305766:C:G, 14:24306489:G:A, 14:24306097:T:C, 14:24305763:T:G, 14:24307447:G:A, 14:24307402:G:A, 14:24305972:C:G, 14:24306423:T:G, 14:24305974:T:TG, 14:24307411:T:C, 14:24306121:T:C, 14:24307516:C:T, 14:24306424:C:T, 14:24306039:G:C, 14:24307853:C:A, 14:24306388:A:G, 14:24305990:T:C, 14:24307822:G:GT, 14:24305640:G:A, 14:24307418:T:C, 14:24305758:G:C, 14:24306131:C:T, 14:24305953:A:G, 14:24305730:C:A, 14:24306418:A:G, 14:24306059:AC:A, 14:24307842:G:A, 14:24307837:T:G, 14:24306095:G:T, 14:24306109:C:T, 14:24307822:G:A, 14:24306077:G:A, 14:24307824:A:T, 14:24306080:C:T, 14:24305649:C:T, 14:24306433:G:GA, 14:24306420:G:C, 14:24305658:T:G, 14:24306472:C:T, 14:24307412:TC:T, 14:24306062:C:A, 14:24306044:G:C, 14:24306047:G:T, 14:24306126:CAG:C, 14:24306449:C:G, 14:24307391:G: A, or 14:24307857:A:C (according to GRCh38/hg38 human genome assembly coordinates).

Detecting the presence or absence of a CIDEB variant nucleic acid molecule in a biological sample from a subject and/or determining whether a subject has a CIDEB variant nucleic acid molecule can be carried out by any of the methods described herein. In some embodiments, these methods can be carried out in vitro. In some embodiments, these methods can be carried out in situ. In some embodiments, these methods can be carried out in vivo. In any of these embodiments, the nucleic acid molecule can be present within a cell obtained from the subject.

In some embodiments, the detecting step comprises obtaining or having obtained a biological sample from the subject, and performing or having performed an assay on the biological sample to determine whether the subject has the CIDEB variant nucleic acid molecule, and/or a CIDEB predicted loss-of-function polypeptide. In some embodiments, the assay is a sequence analysis that comprises sequencing at least a portion of the nucleotide sequence of the CIDEB genomic nucleic acid molecule in the biological sample. In some embodiments, the assay is a sequence analysis that comprises sequencing at least a portion of the nucleotide sequence of the CIDEB mRNA molecule in the biological sample. In some embodiments, the assay is a sequence analysis that comprises sequencing at least a portion of the nucleotide sequence of the CIDEB cDNA molecule produced from an mRNA molecule in the biological sample.

In some embodiments, the sequence analysis comprises: a) contacting the biological sample with a primer hybridizing to a portion of the nucleotide sequence of the CIDEB nucleic acid molecule that is proximate to a CIDEB variant nucleic acid molecule position; b) extending the primer at least through the CIDEB variant nucleic acid molecule position; and c) determining whether the extension product of the primer comprises a variant nucleotide at the CIDEB variant nucleic acid molecule position. In some embodiments, the sequence analysis comprises sequencing the entire nucleic acid molecule in the biological sample.

In some embodiments, the assay is a sequence analysis that comprises: a) amplifying at least a portion of the CIDEB nucleic acid molecule in the biological sample, wherein the portion comprises a CIDEB variant nucleic acid molecule position; b) labeling the amplified nucleic acid molecule with a detectable label; c) contacting the labeled nucleic acid molecule with a support comprising an alteration-specific probe, wherein the alteration-specific probe comprises a nucleotide sequence which hybridizes under stringent conditions to the CIDEB variant nucleic acid molecule position; and d) detecting the detectable label. In some embodiments, the CIDEB nucleic acid molecule in the biological sample is mRNA and the mRNA is reverse-transcribed into cDNA prior to the amplifying step.

In some embodiments, the assay is a sequence analysis that comprises contacting the CIDEB nucleic acid molecule in the biological sample with an alteration-specific probe comprising a detectable label, wherein the alteration-specific probe comprises a nucleotide sequence which hybridizes under stringent conditions to a CIDEB variant nucleic acid molecule position, and detecting the detectable label.

In some embodiments, the assay is an immunoassay for detecting the presence of a CIDEB predicted loss-of-function polypeptide. In some embodiments, mass spectrometry is used for detecting the presence of a CIDEB predicted loss-of-function polypeptide.

In some embodiments, the methods further comprise determining the subject's gene burden of having a CIDEB variant nucleic acid molecule and/or a CIDEB predicted loss-of-function polypeptide. When the subject has a lower gene burden, the subject is administered or continued to be administered the CIDEB inhibitor in a standard dosage amount. When the subject has a greater gene burden, the subject is administered or continued to be administered the CIDEB inhibitor in an amount that is the same as or less than the standard dosage amount. In some embodiments, the subject's gene burden represents a weighted sum of a plurality of genetic variants associated with protection against developing a liver disease. In some embodiments, the gene burden is calculated using at least about 2, at least about 3, at least about 4, at least about 5, at least about 10, at least about 20, at least about 30, at least about 40, at least about 50, at least about 60, at least about 70, at least about 80, at least about 100, at least about 120, at least about 150, at least about 200, at least about 250, at least about 300, at least about 400, at least about 500, or at least about 1,000 genetic variants associated with liver disease. In some embodiments, the gene burden may be divided into quintiles, e.g., top quintile, intermediate quintile, and bottom quintile, wherein the top quintile of gene burden corresponds to the lowest risk group and the bottom quintile of gene burden corresponds to the highest risk group.

The sequence analysis to determine whether a subject has a CIDEB variant nucleic acid molecule can be carried out by any of the methods described herein. In some embodiments, these methods can be carried out in vitro. In some embodiments, these methods can be carried out in situ. In some embodiments, these methods can be carried out in vivo. In any of these embodiments, the nucleic acid molecule can be present within a cell obtained from the subject.

In some embodiments, the methods further comprise detecting the presence or absence of a PNPLA3 variant nucleic acid molecule encoding PNPLA3 Ile148Met or PNPLA3 Ile144Met polypeptide and/or a PNPLA3 Ile148Met or a PNPLA3 Ile144Met polypeptide in a biological sample from the subject. In some embodiments, the PNPLA3 variant nucleic acid molecule is a genomic DNA molecule comprising a guanine at a position corresponding to position 5109 according to SEQ ID NO:43; an mRNA molecule comprising a guanine at a position corresponding to position 444 according to SEQ ID NO:46, or a guanine at a position corresponding to position 432 according to SEQ ID NO:47; a cDNA molecule produced from an mRNA molecule, wherein the cDNA molecule has a nucleotide sequence comprising: a guanine at a position corresponding to position 444 according to SEQ ID NO: 50, or a guanine at a position corresponding to position 432 according to SEQ ID NO:51.

Detecting the presence or absence of a PNPLA3 variant nucleic acid molecule encoding PNPLA3 Ile148Met or PNPLA3 Ile144Met polypeptide in a biological sample from a subject and/or determining whether a subject has a PNPLA3 variant nucleic acid molecule encoding PNPLA3 Ile148Met or PNPLA3 Ile144Met polypeptide can be carried out by any of the methods described herein. In some embodiments, these methods can be carried out in vitro. In some embodiments, these methods can be carried out in situ. In some embodiments, these methods can be carried out in vivo. In any of these embodiments, the nucleic acid molecule can be present within a cell obtained from the subject.

In some embodiments, the detecting step comprises obtaining or having obtained a biological sample from the subject, and performing or having performed an assay on the biological sample to determine whether the subject has: i) a PNPLA3 genomic nucleic acid molecule comprising a guanine at a position corresponding to position 5109 according to SEQ ID NO:43, or a complement thereof; ii) a PNPLA3 mRNA molecule comprising: a guanine at a position corresponding to position 444 according to SEQ ID NO:46, or a guanine at a position corresponding to position 432 according to SEQ ID NO:47, or a complement thereof; or iii) a PNPLA3 cDNA molecule comprising: a guanine at a position corresponding to position 444 according to SEQ ID NO: 50, or a guanine at a position corresponding to position 432 according to SEQ ID NO:51, or a complement thereof.

In some embodiments, the sequence analysis comprises: a) contacting the biological sample with a primer hybridizing to: i) a portion of the nucleotide sequence of the PNPLA3 genomic nucleic acid molecule, or a complement thereof, that is proximate to a position corresponding to position 5109 according to SEQ ID NO:43; ii) a portion of the nucleotide sequence of the PNPLA3 mRNA molecule, or the complement thereof, that is proximate to a position corresponding to position 444 according to SEQ ID NO:46, or position 432 according to SEQ ID NO:47; or iii) a portion of the nucleotide sequence of the PNPLA3 cDNA molecule, or the complement thereof, that is proximate to a position corresponding to position 444 according to SEQ ID NO:50, or position 432 according to SEQ ID NO:51; b) extending the primer at least through: i) position of the nucleotide sequence of PNPLA3 genomic nucleic acid molecule, or a complement thereof corresponding to position corresponding to position 5109 according to SEQ ID NO:43; ii) position of the nucleotide sequence of PNPLA3 mRNA molecule, or a complement thereof corresponding to a position corresponding to position 444 according to SEQ ID NO:46, or position 432 according to SEQ ID NO:47; or iii) position of the nucleotide sequence of PNPLA3 cDNA molecule, or a complement thereof corresponding to a position corresponding to position 444 according to SEQ ID NO:50, or position 432 according to SEQ ID NO:51; and c) determining whether the extension product of the primer comprises: a guanine at a position corresponding to position 5109 according to SEQ ID NO:43, or a complement thereof; a guanine at a position corresponding to position 444 according to SEQ ID NO:46, or a guanine at a position corresponding to position 432 according to SEQ ID NO:47, or a complement thereof; or a guanine at a position corresponding to position 444 according to SEQ ID NO:50, or a guanine at a position corresponding to position 432 according to SEQ ID NO:51, or a complement thereof.

In some embodiments, the assay is a sequence analysis that comprises a) amplifying at least a portion of: i) a PNPLA3 genomic nucleic acid molecule comprising a guanine at a position corresponding to position 5109 according to SEQ ID NO:43, or a complement thereof; ii) a PNPLA3 mRNA molecule comprising: a guanine at a position corresponding to position 444 according to SEQ ID NO:46, or a guanine at a position corresponding to position 432 according to SEQ ID NO:47, or a complement thereof; or iii) a PNPLA3 cDNA molecule comprising: a guanine at a position corresponding to position 444 according to SEQ ID NO: 50, or a guanine at a position corresponding to position 432 according to SEQ ID NO:51; b) labeling the amplified nucleic acid molecule with a detectable label; c) contacting the labeled nucleic acid molecule with a support comprising an alteration-specific probe, wherein the alteration-specific probe comprises a nucleotide sequence which hybridizes under stringent conditions to the nucleotide sequence of the amplified nucleic acid molecule comprising: i) a guanine at a position corresponding to position 5109 according to SEQ ID NO:43, or a complement thereof; ii) a guanine at a position corresponding to position 444 according to SEQ ID NO:46, or a guanine at a position corresponding to position 432 according to SEQ ID NO:47, or a complement thereof; or iii) a guanine at a position corresponding to position 444 according to SEQ ID NO:50, or a guanine at a position corresponding to position 432 according to SEQ ID NO:51, or a complement thereof; and d) detecting the detectable label.

In some embodiments, the assay is a sequence analysis that comprises contacting the PNPLA3 nucleic acid molecule in the biological sample with an alteration-specific probe comprising a detectable label, wherein the alteration-specific probe comprises a nucleotide sequence which hybridizes under stringent conditions to: i) a PNPLA3 genomic nucleic acid molecule comprising a guanine at a position corresponding to position 5109 according to SEQ ID NO:43, or a complement thereof; ii) a PNPLA3 mRNA molecule comprising: a guanine at a position corresponding to position 444 according to SEQ ID NO:46, or a guanine at a position corresponding to position 432 according to SEQ ID NO:47, or a complement thereof; or iii) a PNPLA3 cDNA molecule comprising: a guanine at a position corresponding to position 444 according to SEQ ID NO: 50, or a guanine at a position corresponding to position 432 according to SEQ ID NO:51; and detecting the detectable label.

The sequence analysis to determine whether a subject has a PNPLA3 variant nucleic acid molecule encoding a PNPLA3 predicted loss-of-function polypeptide can be carried out by any of the methods described herein. In some embodiments, these methods can be carried out in vitro. In some embodiments, these methods can be carried out in situ. In some embodiments, these methods can be carried out in vivo. In any of these embodiments, the nucleic acid molecule can be present within a cell obtained from the subject.

In some embodiments, the assay is an immunoassay for detecting the presence of a PNPLA3 Ile148Met or Ile144Met variant polypeptide. In some embodiments, mass spectrometry is used for detecting the presence of a PNPLA3 Ile148Met or Ile144Met variant polypeptide.

In some embodiments, the methods further comprise detecting the presence or absence of a nucleic acid molecule encoding a reference HSD17B13 polypeptide or a functional HSD17B13 polypeptide and/or a reference HSD17B13 polypeptide or a functional HSD17B13 polypeptide in a biological sample from the subject. In some embodiments, the nucleic acid molecule encoding the reference HSD17B13 polypeptide or a functional HSD17B13 polypeptide comprises: a genomic nucleic acid molecule comprising the nucleotide sequence according to SEQ ID NO:52, or a nucleotide sequence having at least 90% sequence identity to SEQ ID NO:52 and encoding a reference HSD17B13 polypeptide or a functional HSD17B13 polypeptide; an mRNA molecule comprising the nucleotide sequence according to any one of SEQ ID NOs:53-62 or a nucleotide sequence having at least 90% sequence identity to SEQ ID NOs:53-62 and encoding a reference HSD17B13 polypeptide or a functional HSD17B13 polypeptide; or a cDNA molecule comprising the nucleotide sequence according to any one of SEQ ID NOs:63-72 or a nucleotide sequence having at least 90% sequence identity to SEQ ID NOs:63-72 and encoding a reference HSD17B13 polypeptide or a functional HSD17B13 polypeptide.

Detecting the presence or absence of a nucleic acid molecule encoding a reference HSD17B13 polypeptide or a functional HSD17B13 polypeptide and/or determining whether a subject has a nucleic acid molecule encoding a reference HSD17B13 polypeptide or a functional HSD17B13 polypeptide can be carried out by any of the methods described herein. In some embodiments, these methods can be carried out in vitro. In some embodiments, these methods can be carried out in situ. In some embodiments, these methods can be carried out in vivo. In any of these embodiments, the nucleic acid molecule can be present within a cell obtained from the subject.

In some embodiments, the detecting step comprises obtaining or having obtained a biological sample from the subject; and performing or having performed an assay on the biological sample to determine whether the subject has: i) an HSD17B13 genomic nucleic acid molecule comprising SEQ ID NO:52, or a nucleotide sequence having at least 90% sequence identity to SEQ ID NO:52 and encoding a reference HSD17B13 polypeptide or a functional HSD17B13 polypeptide; ii) an HSD17B13 mRNA molecule comprising any one of SEQ ID NOs:53-62, or a nucleotide sequence having at least 90% sequence identity to any one of SEQ ID NOs:53-62 and encoding a reference HSD17B13 polypeptide or a functional HSD17B13 polypeptide; or iii) an HSD17B13 cDNA molecule comprising any one of SEQ ID NOs:63-72, or a nucleotide sequence having at least 90% sequence identity to any one of SEQ ID NOs:63-72 and encoding a reference HSD17B13 polypeptide or a functional HSD17B13 polypeptide.

In some embodiments, the sequence analysis comprises sequencing at least a portion of the nucleotide sequence of the HSD17B13 genomic nucleic acid molecule, mRNA molecule, or cDNA molecule produced from mRNA molecule in the biological sample.

In some embodiments, the assay is an immunoassay for detecting the presence of an HSD17B13 wild type or reference polypeptide. In some embodiments, mass spectrometry is used for detecting the presence of an HSD17B13 wild type or reference polypeptide.

In any of the embodiments described herein, when the subject is CIDEB reference, the subject can be administered the CIDEB inhibitor in a standard dosage amount. When the subject is heterozygous for a CIDEB variant nucleic acid molecule encoding a CIDEB predicted loss-of-function polypeptide, the subject can be administered the CIDEB inhibitor in a dosage amount that is the same as or less than a standard dosage amount. The CIDEB inhibitor can also be administered in combination with one or more PNPLA3 inhibitors and/or one or more HSD17B13 inhibitors.

In any of the embodiments described herein, when the subject is CIDEB reference or is heterozygous for a CIDEB variant nucleic acid molecule and is also a carrier for a nucleic acid molecule encoding a PNPLA3 Ile148Met or an Ile144Met polypeptide, such a subject can be treated with a combination of one or more CIDEB inhibitors, one or more PNPLA3 inhibitors and/or one or more HSD17B13 inhibitors.

In any of the embodiments described herein, when the subject is homozygous for a nucleic acid molecule encoding a reference HSD17B13 polypeptide or a functional HSD17B13 polypeptide, the subject is administered a CIDEB inhibitor in an amount that is the same as or greater than a standard dosage amount, or is administered a combination of a CIDEB inhibitor in an amount that is the same as or greater than a standard dosage amount, an HSD17B13 inhibitor, and/or a PNPLA3 inhibitor. When the subject is not homozygous for a nucleic acid molecule encoding a reference HSD17B13 polypeptide or a functional HSD17B13 polypeptide (i.e., is a carrier for a loss-of-function HSD17B13), the subject is administered a CIDEB inhibitor in an amount that is less than a standard dosage amount, or is administered a combination of a CIDEB inhibitor in an amount that is less than a standard dosage amount, an HSD17B13 inhibitor, and/or a PNPLA3 inhibitor.

In some embodiments, when the subject is CIDEB reference, the subject is also administered a therapeutic agent that treats or inhibits liver disease in a standard dosage amount. In some embodiments, when the subject is heterozygous for a CIDEB variant nucleic acid molecule, the subject is also administered a therapeutic agent that treats or inhibits liver disease in a dosage amount that is the same as or less than a standard dosage amount.

In some embodiments, the treatment methods further comprise detecting the presence or absence of a CIDEB predicted loss-of-function polypeptide in a biological sample from the subject. In some embodiments, when the subject does not have a CIDEB predicted loss-of-function or polypeptide, the subject is also administered a therapeutic agent that treats or inhibits liver disease in a standard dosage amount. In some embodiments, when the subject has a CIDEB predicted loss-of-function polypeptide, the subject is also administered a therapeutic agent that treats or inhibits liver disease in a dosage amount that is the same as or less than a standard dosage amount.

In some embodiments, the treatment methods further comprise detecting the presence or absence of a PNPLA3 Ile148Met or an Ile144Met polypeptide in a biological sample from the subject. In some embodiments, when the subject has a CIDEB predicted loss-of-function polypeptide and a PNPLA3 Ile148Met or an Ile144Met polypeptide, the subject is also administered a therapeutic agent that treats or inhibits liver disease in a dosage amount that is the same as or greater than a standard dosage amount.

In some embodiments, the treatment methods further comprise detecting the presence or absence of a reference HSD17B13 polypeptide or a functional HSD17B13 polypeptide in a biological sample from the subject. In some embodiments, when the subject is homozygous for a nucleic acid molecule encoding a reference HSD17B13 polypeptide or a functional HSD17B13 polypeptide, the subject is administered a CIDEB inhibitor in an amount that is the same as or greater than a standard dosage amount, or is administered a combination of a CIDEB inhibitor in an amount that is the same as or greater than a standard dosage amount, an HSD17B13 inhibitor, and/or a PNPLA3 inhibitor. When the subject is not homozygous for a nucleic acid molecule encoding a reference HSD17B13 polypeptide or a functional HSD17B13 polypeptide (i.e., is a carrier for a loss-of-function HSD17B13), the subject is administered a CIDEB inhibitor in an amount that is less than a standard dosage amount, or is administered a combination of a CIDEB inhibitor in an amount that is less than a standard dosage amount, an HSD17B13 inhibitor, and/or a PNPLA3 inhibitor.

The present disclosure also provides methods of treating a subject with a CIDEB inhibitor, wherein the subject has a liver disease or is at risk of developing a liver disease. The methods comprise determining whether the subject has a CIDEB variant nucleic acid molecule by obtaining or having obtained a biological sample from the subject, and performing or having performed a sequence analysis on the biological sample to determine if the subject has a genotype comprising the CIDEB variant nucleic acid molecule. When the subject is CIDEB reference, the method further comprises administering or continuing to administer to the subject the CIDEB inhibitor in a standard dosage amount. When the subject is heterozygous for the CIDEB variant nucleic acid molecule, the method further comprises administering or continuing to administer to the subject the CIDEB inhibitor in a dosage amount that is the same as or less than a standard dosage amount. The presence of a genotype having the CIDEB variant nucleic acid molecule indicates the subject has a decreased risk of developing the liver disease or has a decreased risk of developing a more severe form of the liver disease. Determining whether the subject has a genotype comprising the CIDEB variant nucleic acid molecule can be carried out as described herein.

In some embodiments, the subject is CIDEB reference, and the subject is administered or continued to be administered the CIDEB inhibitor in a standard dosage amount. In some embodiments, the subject is heterozygous for the CIDEB variant nucleic acid molecule, and the subject is administered or continued to be administered the CIDEB inhibitor in a dosage amount that is the same as or less than a standard dosage amount.

In some embodiments, the subject is CIDEB reference or is heterozygous for the CIDEB variant nucleic acid molecule and the subject is a carrier of a nucleic acid molecule encoding a PNPLA3 Ile148Met or an Ile144Met polypeptide, the subject is administered or continued to be administered the CIDEB inhibitor and is also administered a PNPLA3 inhibitor and/or an HSD17B13 inhibitor.

In some embodiments, the subject is CIDEB reference or heterozygous for the CIDEB variant nucleic acid molecule and the subject is a carrier of a nucleic acid molecule encoding a reference HSD17B13 polypeptide or a functional HSD17B13 polypeptide, the subject is administered or continued to be administered the CIDEB inhibitor and is also administered an HSD17B13 inhibitor and/or a PNPLA3 inhibitor.

In any of the embodiments described herein, the method can further comprise administering a therapeutic agent for treating a liver disease to the subject.

In some embodiments, the subject being treated with the CIDEB inhibitor, the PNPLA3 inhibitor, or the HSD17B13 inhibitor, or any combination thereof, has excessive weight, has elevated BMI, is obese, has elevated body fat mass, has elevated percentage of liver fat, has elevated body fat percentage, has elevated body fat volume, and/or has excessive food intake. In some embodiments, the subject is obese. In some embodiments, the subject has excessive weight. In some embodiments, the subject has elevated BMI. In some embodiments, the subject has elevated body fat mass. In some embodiments, the subject has elevated body fat percentage. In some embodiments, the subject has elevated percentage of liver fat. In some embodiments, the subject has elevated body fat volume. In some embodiments, the subject has excessive food intake. In such subjects, the CIDEB inhibitor, the PNPLA3 inhibitor, or the HSD17B13 inhibitor, or any combination thereof, is administered to treat or prevent the complications of liver injury, liver fat accumulation, liver inflammation, fibrosis, liver cirrhosis or its comorbidities. In some embodiments, the CIDEB inhibitor, the PNPLA3 inhibitor, or the HSD17B13 inhibitor, or any combination thereof, is administered to treat or prevent the complications of liver injury, liver fat accumulation, liver inflammation, fibrosis, liver cirrhosis, or its comorbidities. In some embodiments, the CIDEB inhibitor, the PNPLA3 inhibitor, the HSD17B13 inhibitor, or any combination thereof, is administered to treat or prevent the complications of liver injury. In some embodiments, the CIDEB inhibitor, the PNPLA3 inhibitor, or the HSD17B13 inhibitor, or any combination thereof, is administered to treat or prevent the complications of liver fat accumulation. In some embodiments, the CIDEB inhibitor, the PNPLA3 inhibitor, or the HSD17B13 inhibitor, or any combination thereof, is administered to treat or prevent the complications of liver inflammation. In some embodiments, the CIDEB inhibitor, the PNPLA3 inhibitor, or the HSD17B13 inhibitor, or any combination thereof, is administered to treat or prevent the complications of fibrosis. In some embodiments, the CIDEB inhibitor, the PNPLA3 inhibitor, or the HSD17B13 inhibitor, or any combination thereof, is administered to treat or prevent the complications of liver cirrhosis or its comorbidities. In some embodiments, BMI is measured, body fat is determined, or fat distribution is determined to determine if the CIDEB inhibitor, the PNPLA3 inhibitor, or the HSD17B13 inhibitor, or any combination thereof, has to be used or used in different doses or patterns of administration. In some embodiments, BMI is measured. In some embodiments, body fat is determined. In some embodiments, fat distribution is determined. In some embodiments, the dosage of the CIDEB inhibitor, the PNPLA3 inhibitor, or the HSD17B13 inhibitor, or any combination thereof, can be increased upon an increase in any one or more of weight, BMI, obesity, body fat mass, liver fat percentage, body fat percentage, body fat volume, and/or food intake.

In some embodiments, the subject being treated with a CIDEB inhibitor, HSD17B13 inhibitor, and/or a PNPLA3 inhibitor is heterozygous or homozygous for a nucleic acid molecule encoding a PNPLA3 Ile148Met or Ile144Met polypeptide. In some embodiments, the subject being treated and having the PNPLA3 Ile148Met or Ile144Met polypeptide is administered the CIDEB inhibitor, the HSD17B13 inhibitor, and/or the PNPLA3 inhibitor to treat or prevent the complications of liver injury, liver fat accumulation, liver inflammation, fibrosis, liver cirrhosis or its comorbidities. In some embodiments, the CIDEB inhibitor, the HSD17B13 inhibitor, and/or the PNPLA3 inhibitor is administered to treat or prevent the complications of liver injury, liver fat accumulation, liver inflammation, fibrosis, liver cirrhosis or its comorbidities. In some embodiments, the CIDEB inhibitor, the HSD17B13 inhibitor, and/or the PNPLA3 inhibitor is administered to treat or prevent the complications of liver injury. In some embodiments, the CIDEB inhibitor, the HSD17B13 inhibitor, and/or the PNPLA3 inhibitor is administered to treat or prevent the complications of liver fat accumulation. In some embodiments, the CIDEB inhibitor, the HSD17B13 inhibitor, and/or the PNPLA3 inhibitor is administered to treat or prevent the complications of liver inflammation. In some embodiments, the CIDEB inhibitor, the HSD17B13 inhibitor, and/or the PNPLA3 inhibitor is administered to treat or prevent the complications of fibrosis. In some embodiments, the CIDEB inhibitor, the HSD17B13 inhibitor, and/or the PNPLA3 inhibitor is administered to treat or prevent the complications of liver cirrhosis or its comorbidities. In some embodiments, the methods further comprise genetic testing for the PNPLA3 Ile148Met or Ile144Met polypeptide to determine if the PNPLA3 inhibitor has to be used or used in a different dose or pattern of administration.

The present disclosure also provides methods of treating a subject having a liver disease or is at risk of developing a liver disease and who is heterozygous or homozygous for a nucleic acid molecule encoding a PNPLA3 Ile148Met or Ile144Met polypeptide, the methods comprising administering a CIDEB inhibitor, an HSD17B13 inhibitor, and/or a PNPLA3 inhibitor to the subject.

The amino acid sequences for two reference PNPLA3 polypeptides are set forth in SEQ ID NO:38 and SEQ ID NO:39. The reference PNPLA3 polypeptide having SEQ ID NO:38 is 481 amino acids in length, whereas the reference PNPLA3 polypeptide having SEQ ID NO:39 is 477 amino acids in length. The reference PNPLA3 polypeptide having SEQ ID NO:38 has an isoleucine at position 148. The reference PNPLA3 polypeptide having SEQ ID NO:39 has an isoleucine at position 144.

The PNPLA3 Ile148Met polypeptide comprises an amino acid sequence set forth in SEQ ID NO:40, where the isoleucine at position 148 is replaced with a methionine. The PNPLA3 Ile144Met polypeptide comprises an amino acid sequence set forth in SEQ ID NO:41, where the isoleucine at position 144 is replaced with a methionine.

The nucleotide sequence of a PNPLA3 genomic nucleic acid molecule encoding a reference PNPLA3 polypeptide is set forth in SEQ ID NO:42. The reference PNPLA3 genomic nucleic acid molecule having SEQ ID NO:42 comprises a cytosine at position 5109. The reference PNPLA3 genomic nucleic acid molecule having SEQ ID NO:42 comprises an ATC codon at positions 5107 to 5109.

The nucleotide sequence of a PNPLA3 variant genomic nucleic acid molecule encoding the PNPLA3 Ile148Met and Ile144Met polypeptide is set forth in SEQ ID NO:43, wherein the cytosine at the position corresponding to position 5109 of the reference PNPLA3 genomic nucleic acid molecule (according to SEQ ID NO:42) is replaced with a guanine, and the ATC codon at the positions corresponding to positions 5107 to 5109 of the reference PNPLA3 genomic DNA molecule (according to SEQ ID NO:42) is replaced by an ATG codon.

The nucleotide sequence of a PNPLA3 mRNA molecule encoding a PNPLA3 reference polypeptide having SEQ ID NO:38 is set forth in SEQ ID NO:44. The mRNA molecule encoding the PNPLA3 reference polypeptide having SEQ ID NO:38 comprises a cytosine at position 444. The mRNA molecule encoding the PNPLA3 reference polypeptide having SEQ ID NO:38 comprises an AUC codon at the positions 442 to 444. The nucleotide sequence of a PNPLA3 mRNA molecule encoding a PNPLA3 reference polypeptide having SEQ ID NO:39 is set forth in SEQ ID NO:45. The mRNA molecule encoding the PNPLA3 reference polypeptide having SEQ ID NO:39 comprises a cytosine at position 432. The mRNA molecule encoding the PNPLA3 reference polypeptide having SEQ ID NO:39 comprises an AUC codon at positions 430 to 432.

The nucleotide sequence of a PNPLA3 mRNA molecule encoding a PNPLA3 Ile148Met polypeptide is set forth in SEQ ID NO:46, wherein the cytosine at the position corresponding to position 444 of the PNPLA3 reference mRNA molecule (according to SEQ ID NO:44) is replaced with a guanine, and the AUC codon at positions corresponding to positions 442 to 444 of the PNPLA3 reference mRNA molecule (according to SEQ ID NO:44) is replaced by an AUG codon. The nucleotide sequence of a PNPLA3 mRNA molecule encoding a PNPLA3 Ile144Met polypeptide is set forth in SEQ ID NO:47, wherein the cytosine at the position corresponding to position 432 of the PNPLA3 reference mRNA molecule (according to SEQ ID NO:45) is replaced with a guanine, and the AUC codon at the positions corresponding to positions 430 to 432 of the PNPLA3 reference mRNA molecule (according to SEQ ID NO:45) is replaced by an AUG codon.

The nucleotide sequence of a PNPLA3 cDNA molecule encoding a PNPLA3 reference polypeptide having SEQ ID NO:38 is set forth in SEQ ID NO:48. The cDNA molecule encoding the PNPLA3 reference polypeptide having SEQ ID NO:38 comprises a cytosine at position 444. The cDNA molecule encoding the PNPLA3 reference polypeptide having SEQ ID NO:38 comprises an ATC codon at positions 442 to 444. The nucleotide sequence of a PNPLA3 cDNA molecule encoding a PNPLA3 reference polypeptide having SEQ ID NO:39 is set forth in SEQ ID NO:49. The cDNA molecule encoding the PNPLA3 reference polypeptide having SEQ ID NO:39 comprises a cytosine at position 432. The cDNA molecule encoding the PNPLA3 reference polypeptide having SEQ ID NO:39 comprises an ATC codon at positions 430 to 432.

The nucleotide sequence of a PNPLA3 cDNA molecule encoding PNPLA3 Ile148Met polypeptide is set forth in SEQ ID NO:50, wherein the cytosine at the position corresponding to position 444 of the PNPLA3 reference cDNA molecule (according to SEQ ID NO:48) is replaced with a guanine, and the ATC codon at positions corresponding to positions 442 to 444 of the PNPLA3 reference cDNA molecule (according to SEQ ID NO:48) is replaced by an ATG codon. The nucleotide sequence of a PNPLA3 cDNA molecule encoding PNPLA3 Ile144Met polypeptide is set forth in SEQ ID NO:51, wherein the cytosine at the position corresponding to position 432 of the PNPLA3 reference cDNA molecule (according to SEQ ID NO:49) is replaced with a guanine, and the ATC codon at positions corresponding to positions 430 to 432 of the PNPLA3 reference cDNA molecule (according to SEQ ID NO:49) is replaced by an ATG codon.

The present disclosure also provides methods of treating a subject with a CIDEB inhibitor and/or a PNPLA3 inhibitor and/or an HSD17B13 inhibitor, wherein the subject has a liver disease or is at risk of developing a liver disease, the methods comprising: determining whether the subject has a nucleic acid molecule encoding a PNPLA3 Ile148Met or Ile144Met polypeptide by: obtaining or having obtained a biological sample from the subject; and performing or having performed a sequence analysis on the biological sample to determine if the subject has a genotype comprising the nucleic acid molecule encoding the PNPLA3 Ile148Met or Ile144Met polypeptide; and administering or continuing to administer the CIDEB inhibitor and/or a PNPLA3 inhibitor and/or an HSD17B13 inhibitor to a subject that is heterozygous or homozygous for the nucleic acid molecule encoding the PNPLA3 Ile148Met or Ile144Met polypeptide; wherein the presence of a genotype having the PNPLA3 nucleic acid molecule encoding the Ile148Met or Ile144Met polypeptide indicates the subject is a candidate for treatment with the CIDEB inhibitor and/or the HSD17B13 inhibitor and/or the PNPLA3 inhibitor. In some embodiments, the PNPLA3 nucleic acid molecule encodes PNPLA3 Ile148Met. In some embodiments, the PNPLA3 nucleic acid molecule encodes PNPLA3 Ile144Met. In some embodiments, the subject is also administered a therapeutic agent that treats or inhibits liver disease.

In some embodiments, the PNPLA3 nucleic acid molecule encoding the Ile148Met or Ile144Met polypeptide is: a genomic nucleic acid molecule having a nucleotide sequence comprising a guanine at a position corresponding to position 5109 according to SEQ ID NO:43; an mRNA molecule having a nucleotide sequence comprising a guanine at a position corresponding to position 444 according to SEQ ID NO:46, or a guanine at a position corresponding to position 432 according to SEQ ID NO:47; or a cDNA molecule produced from an mRNA molecule, wherein the cDNA molecule has a nucleotide sequence comprising a guanine at a position corresponding to position 444 according to SEQ ID NO: 50, or a guanine at a position corresponding to position 432 according to SEQ ID NO:51.

Methods of detection of any of the PNPLA3 genomic nucleic acid molecules, mRNA molecules, cDNA molecules, or polypeptides can be carried out by gene chip assays, bead assays, sequencing, or immunoassays.

In some embodiments, the sequence analysis comprises sequencing at least a portion of the nucleotide sequence of the PNPLA3 genomic nucleic acid molecule in the biological sample, wherein the sequenced portion comprises a position corresponding to position 5109 according to SEQ ID NO:43, or the complement thereof. In some embodiments, the sequence analysis comprises sequencing at least a portion of the nucleotide sequence of the PNPLA3 mRNA molecule in the biological sample, wherein the sequenced portion comprises a position corresponding to position 444 according to SEQ ID NO:46, or the complement thereof, or position 432 according to SEQ ID NO:47, or the complement thereof. In some embodiments, the sequence analysis comprises sequencing at least a portion of the nucleotide sequence of the PNPLA3 cDNA molecule in the biological sample, wherein the sequenced portion comprises a position corresponding to position 444 according to SEQ ID NO:50, or the complement thereof, or position 432 according to SEQ ID NO:51, or the complement thereof.

In some embodiments, the sequence analysis comprises: a) contacting the biological sample with a primer hybridizing to a portion of the nucleotide sequence of the PNPLA3 genomic nucleic acid molecule that is proximate to a position corresponding to position 5109 according to SEQ ID NO:43; b) extending the primer at least through the position of the nucleotide sequence of the PNPLA3 genomic nucleic acid molecule corresponding to position 5109 according to SEQ ID NO:43; and c) determining whether the extension product of the primer comprises a guanine at a position corresponding to position 5109 according to SEQ ID NO:43.

In some embodiments, the sequence analysis comprises: a) contacting the biological sample with a primer hybridizing to a portion of the nucleotide sequence of the PNPLA3 mRNA molecule that is proximate to a position corresponding to position 444 according to SEQ ID NO:46, or position 432 according to SEQ ID NO:47; b) extending the primer at least through the position of the nucleotide sequence of the PNPLA3 mRNA molecule corresponding to position 444 according to SEQ ID NO:46, or position 432 according to SEQ ID NO:47; and c) determining whether the extension product of the primer comprises a guanine at a position corresponding to position 444 according to SEQ ID NO:46, or a guanine at a position corresponding to position 432 according to SEQ ID NO:47.

In some embodiments, the sequence analysis comprises: a) contacting the biological sample with a primer hybridizing to a portion of the nucleotide sequence of the PNPLA3 cDNA molecule that is proximate to a position corresponding to position 444 according to SEQ ID NO:50, or position 432 according to SEQ ID NO:51; b) extending the primer at least through the position of the nucleotide sequence of the PNPLA3 cDNA molecule corresponding to position 444 according to SEQ ID NO:50, or position 432 according to SEQ ID NO:51; and c) determining whether the extension product of the primer comprises a guanine at a position corresponding to position 444 according to SEQ ID NO:50, or a guanine at a position corresponding to position 432 according to SEQ ID NO:51.

In some embodiments, the sequence analysis comprises sequencing the entire nucleic acid molecule.

In some embodiments, the sequence analysis comprises: a) amplifying at least a portion of the nucleic acid molecule that encodes the PNPLA3 polypeptide, wherein the portion comprises a guanine at a position corresponding to position 5109 according to SEQ ID NO:43, or the complement thereof; b) labeling the amplified nucleic acid molecule with a detectable label; c) contacting the labeled nucleic acid molecule with a support comprising an alteration-specific probe, wherein the alteration-specific probe comprises a nucleotide sequence which hybridizes under stringent conditions to the nucleic acid sequence of the amplified nucleic acid molecule comprising a guanine at a position corresponding to position 5109 according to SEQ ID NO:43, or the complement thereof; and d) detecting the detectable label.

In some embodiments, the sequence analysis comprises: a) amplifying at least a portion of the nucleic acid molecule that encodes the PNPLA3 polypeptide, wherein the portion comprises a guanine at a position corresponding to position 444 according to SEQ ID NO:46, or the complement thereof; or a guanine at a position corresponding to position 432 according to SEQ ID NO:47, or the complement thereof; b) labeling the amplified nucleic acid molecule with a detectable label; c) contacting the labeled nucleic acid molecule with a support comprising an alteration-specific probe, wherein the alteration-specific probe comprises a nucleotide sequence which hybridizes under stringent conditions to the nucleic acid sequence of the amplified nucleic acid molecule comprising a guanine at a position corresponding to position 444 according to SEQ ID NO:46, or the complement thereof; or a guanine at a position corresponding to position 432 according to SEQ ID NO:47, or the complement thereof; and d) detecting the detectable label.

In some embodiments, the sequence analysis comprises: a) amplifying at least a portion of the nucleic acid molecule that encodes the PNPLA3 polypeptide, wherein the portion comprises a guanine at a position corresponding to position 444 according to SEQ ID NO:50, or the complement thereof; or a guanine at a position corresponding to position 432 according to SEQ ID NO:51, or the complement thereof; b) labeling the amplified nucleic acid molecule with a detectable label; c) contacting the labeled nucleic acid molecule with a support comprising an alteration-specific probe, wherein the alteration-specific probe comprises a nucleotide sequence which hybridizes under stringent conditions to the nucleic acid sequence of the amplified nucleic acid molecule comprising a guanine at a position corresponding to position 444 according to SEQ ID NO:50, or the complement thereof; or a guanine at a position corresponding to position 432 according to SEQ ID NO:51, or the complement thereof; and d) detecting the detectable label. In some embodiments, the nucleic acid molecule in the sample is mRNA and the mRNA is reverse-transcribed into cDNA prior to the amplifying step.

In some embodiments, the sequence analysis comprises: contacting the nucleic acid molecule in the biological sample with an alteration-specific probe comprising a detectable label, wherein the alteration-specific probe comprises a nucleotide sequence which hybridizes under stringent conditions to the nucleotide sequence of the amplified nucleic acid molecule comprising a guanine at a position corresponding to position 5109 according to SEQ ID NO:43, or the complement thereof; and detecting the detectable label. In some embodiments, the sequence analysis comprises: contacting the nucleic acid molecule in the biological sample with an alteration-specific probe comprising a detectable label, wherein the alteration-specific probe comprises a nucleotide sequence which hybridizes under stringent conditions to the nucleotide sequence of the amplified nucleic acid molecule comprising a guanine at a position corresponding to position 444 according to SEQ ID NO:46, or the complement thereof; or a guanine at a position corresponding to position 432 according to SEQ ID NO:47, or the complement thereof; and detecting the detectable label. In some embodiments, the sequence analysis comprises: contacting the nucleic acid molecule in the biological sample with an alteration-specific probe comprising a detectable label, wherein the alteration-specific probe comprises a nucleotide sequence which hybridizes under stringent conditions to the nucleotide sequence of the amplified nucleic acid molecule comprising a guanine at a position corresponding to position 444 according to SEQ ID NO:50, or the complement thereof; or a guanine at a position corresponding to position 432 according to SEQ ID NO:51, or the complement thereof; and detecting the detectable label.

In some embodiments, the subject being treated with a CIDEB inhibitor, an HSD17B13 inhibitor, and/or a PNPLA3 inhibitor is heterozygous or homozygous for a nucleic acid molecule encoding a reference HSD17B13 polypeptide or a functional HSD17B13 polypeptide. In some embodiments, the subject being treated and having a nucleic acid molecule encoding a reference HSD17B13 polypeptide or a functional HSD17B13 polypeptide is administered the CIDEB inhibitor, the HSD17B13 inhibitor, and/or the PNPLA3 inhibitor to treat or prevent the complications of liver injury, liver fat accumulation, liver inflammation, fibrosis, liver cirrhosis or its comorbidities. In some embodiments, the CIDEB inhibitor, the HSD17B13 inhibitor, and/or the PNPLA3 inhibitor is administered to treat or prevent the complications of liver injury, liver fat accumulation, liver inflammation, fibrosis, liver cirrhosis or its comorbidities. In some embodiments, the CIDEB inhibitor, the HSD17B13 inhibitor, and/or the PNPLA3 inhibitor is administered to treat or prevent the complications of liver injury. In some embodiments, the CIDEB inhibitor, the HSD17B13 inhibitor, and/or the PNPLA3 inhibitor is administered to treat or prevent the complications of liver fat accumulation. In some embodiments, the CIDEB inhibitor, the HSD17B13 inhibitor, and/or the PNPLA3 inhibitor is administered to treat or prevent the complications of liver inflammation. In some embodiments, the CIDEB inhibitor, the HSD17B13 inhibitor, and/or the PNPLA3 inhibitor is administered to treat or prevent the complications of fibrosis. In some embodiments, the CIDEB inhibitor, the HSD17B13 inhibitor, and/or the PNPLA3 inhibitor is administered to treat or prevent the complications of liver cirrhosis or its comorbidities. In some embodiments, the methods further comprise genetic testing for the reference HSD17B13 polypeptide or a functional HSD17B13 polypeptide to determine if the CIDEB inhibitor, the HSD17B13 inhibitor, and/or the PNPLA3 inhibitor has to be used or used in different doses or patterns of administration.

The present disclosure also provides methods of treating a subject having a liver disease or at risk of developing a liver disease and who is heterozygous or homozygous for a nucleic acid encoding a reference HSD17B13 polypeptide or a functional HSD17B13 polypeptide, the methods comprising administering a CIDEB inhibitor, an HSD17B13 inhibitor, and/or a PNPLA3 inhibitor to the subject.

The amino acid sequences of two reference HSD17B13 polypeptides are set forth in SEQ ID NO:73 and SEQ ID NO:74. The reference HSD17B13 polypeptide having SEQ ID NO:73 is 264 amino acids in length, whereas the reference HSD17B13 polypeptide having SEQ ID NO:74 is 300 amino acids in length.

The nucleotide sequence of a genomic nucleic acid molecule encoding a reference HSD17B13 polypeptide is set forth in SEQ ID NO:52 (corresponding to ENSG00000170509.8 located at chr4:87,303,789-87,322,906 according to GRCh38/hg38 Human Genome Assembly).

The nucleotide sequence of an mRNA molecule encoding a reference HSD17B13 polypeptide is set forth in SEQ ID NO:53. The nucleotide sequence of another mRNA molecule encoding a reference HSD17B13 polypeptide is set forth in SEQ ID NO:54. The nucleotide sequence of another mRNA molecule encoding a reference HSD17B13 polypeptide is set forth in SEQ ID NO:55. The nucleotide sequence of another mRNA molecule encoding a reference HSD17B13 polypeptide is set forth in SEQ ID NO:56. The nucleotide sequence of another mRNA molecule encoding a reference HSD17B13 polypeptide is set forth in SEQ ID NO:57. The nucleotide sequence of another mRNA molecule encoding a reference HSD17B13 polypeptide is set forth in SEQ ID NO:58. The nucleotide sequence of another mRNA molecule encoding a reference HSD17B13 polypeptide is set forth in SEQ ID NO:59. The nucleotide sequence of another mRNA molecule encoding a reference HSD17B13 polypeptide is set forth in SEQ ID NO:60. The nucleotide sequence of another mRNA molecule encoding a reference HSD17B13 polypeptide is set forth in SEQ ID NO:61. The nucleotide sequence of another mRNA molecule encoding a reference HSD17B13 polypeptide is set forth in SEQ ID NO:62.

The nucleotide sequence of a cDNA molecule encoding a reference HSD17B13 polypeptide is set forth in SEQ ID NO:63. The nucleotide sequence of another cDNA molecule encoding a reference HSD17B13 polypeptide is set forth in SEQ ID NO:64. The nucleotide sequence of another cDNA molecule encoding a reference HSD17B13 polypeptide is set forth in SEQ ID NO:65. The nucleotide sequence of another cDNA molecule encoding a reference HSD17B13 polypeptide is set forth in SEQ ID NO:66. The nucleotide sequence of another cDNA molecule encoding a reference HSD17B13 polypeptide is set forth in SEQ ID NO:67. The nucleotide sequence of another cDNA molecule encoding a reference HSD17B13 polypeptide is set forth in SEQ ID NO:68. The nucleotide sequence of another cDNA molecule encoding a reference HSD17B13 polypeptide is set forth in SEQ ID NO:69. The nucleotide sequence of another cDNA molecule encoding a reference HSD17B13 polypeptide is set forth in SEQ ID NO:70. The nucleotide sequence of another cDNA molecule encoding a reference HSD17B13 polypeptide is set forth in SEQ ID NO:71. The nucleotide sequence of another cDNA molecule encoding a reference HSD17B13 polypeptide is set forth in SEQ ID NO:72.

The present disclosure also provides methods of treating a subject with a CIDEB inhibitor, an HSD17B13 inhibitor, and/or a PNPLA3 inhibitor, wherein the subject has a liver disease or is at risk of developing a liver disease, the methods comprising: determining whether the subject has a nucleic acid molecule encoding a reference HSD17B13 polypeptide or a functional HSD17B13 polypeptide by: obtaining or having obtained a biological sample from the subject; and performing or having performed an assay on the biological sample to determine whether the subject has: i) an HSD17B13 genomic nucleic acid molecule comprising SEQ ID NO:52, or a nucleotide sequence having at least 90% sequence identity to SEQ ID NO:52 and encoding a reference HSD17B13 polypeptide or a functional HSD17B13 polypeptide; ii) an HSD17B13 mRNA molecule comprising any one of SEQ ID NOs:53-62 or a nucleotide sequence having at least 90% sequence identity to any one of SEQ ID NOs:53-62 and encoding a reference HSD17B13 polypeptide or a functional HSD17B13 polypeptide; or iii) an HSD17B13 cDNA molecule comprising any one of SEQ ID NOs:63-72 or a nucleotide sequence having at least 90% sequence identity to any one of SEQ ID NOs:63-72 and encoding a reference HSD17B13 polypeptide or a functional HSD17B13 polypeptide, wherein the presence of a genotype having a nucleic acid molecule encoding a reference HSD17B13 polypeptide or a functional HSD17B13 polypeptide indicates the subject is a candidate for treatment with the CIDEB inhibitor, the HSD17B13 inhibitor, and/or the PNPLA3 inhibitor. In some embodiments, the subject is also administered a therapeutic agent that treats or inhibits liver disease.

In some embodiments, the nucleic acid molecule encoding the reference HSD17B13 polypeptide or a functional HSD17B13 polypeptide is: a genomic nucleic acid molecule comprising the nucleotide sequence according to SEQ ID NO:52, or a nucleotide sequence having at least 90% sequence identity to SEQ ID NO:52 and encoding a reference HSD17B13 polypeptide or a functional HSD17B13 polypeptide; an mRNA comprising the nucleotide sequence according to any one of SEQ ID NOs:53-62, or a nucleotide sequence having at least 90% sequence identity to any one of SEQ ID NOs:53-62 and encoding a reference HSD17B13 polypeptide or a functional HSD17B13 polypeptide; or a cDNA comprising the nucleotide sequence according to any one of SEQ ID NOs:63-72 or a nucleotide sequence having at least 90% sequence identity to any one of SEQ ID NOs:63-72 and encoding a reference HSD17B13 polypeptide or a functional HSD17B13 polypeptide.

Methods of detection of any of the HSD17B13 genomic nucleic acid molecules, mRNA molecules, cDNA molecules, or polypeptides can be carried out by gene chip assays, bead assays, sequencing, or immunoassays.

In some embodiments, the sequence analysis comprises sequencing at least a portion of the nucleotide sequence of the HSD17B13 genomic DNA, mRNA or cDNA produced from mRNA molecule in the biological sample.

In some embodiments, the sequence analysis comprises sequencing the entire nucleic acid molecule.

In some embodiments, the nucleic acid molecule is present within a cell obtained from the subject.

In some embodiments, the CIDEB inhibitor comprises an inhibitory nucleic acid molecule. In some embodiments, the inhibitory nucleic acid molecule comprises an antisense nucleic acid molecule, an siRNA, or an shRNA that hybridizes to a CIDEB nucleic acid molecule.

Examples of therapeutic agents that treat or inhibit liver disease include, but are not limited to: disulfiram, naltrexone, acamprosate, prednisone, azathioprine, penicillamine, trientine, deferoxamine, ciprofloxacin, norofloxacin, ceftriaxone, ofloxacin, amoxicillin-clavulanate, phytonadione, bumetanide, furosemide, hydrochlorothiazide, chlorothiazide, amiloride, triamterene, spironolactone, octreotide, atenolol, metoprolol, nadolol, propranolol, timolol, and carvedilol, or any combination thereof.

Additional examples of liver disease therapeutic agents (e.g., for use in chronic hepatitis C treatment) include, but are not limited to, ribavirin, paritaprevir, OLYSIO® (simeprevir), grazoprevir, ledipasvir, ombitasvir, elbasvir, DAKLINZA® (daclatasvir), dasabuvir, ritonavir, sofosbuvir, velpatasvir, voxilaprevir, glecaprevir, pibrentasvir, peginterferon alfa-2a, peginterferon alfa-2b, and interferon alfa-2b, or any combination thereof.

Additional examples of liver disease therapeutic agents (e.g., for use in nonalcoholic fatty liver disease) include, but are not limited to, weight loss inducing agents such as orlistat or sibutramine; insulin sensitizing agents such as thiazolidinediones (TZDs), metformin, and meglitinides; lipid lowering agents such as statins, fibrates, and omega-3 fatty acids; antioxidants such as, vitamin E, betaine, N-Acetyl-cysteine, lecithin, silymarin, and beta-carotene; anti TNF agents such as pentoxifylline; probiotics, such as VSL #3; and cytoprotective agents such as ursodeoxycholic acid (UDCA), or any combination thereof. Other suitable treatments include ACE inhibitors/ARBs, oligofructose, and Incretin analogs.

Additional examples of liver disease therapeutic agents (e.g., for use in NASH) include, but are not limited to, OCALIVA® (obeticholic acid), Selonsertib, Elafibranor, Cenicriviroc, GR_MD_02, MGL_3196, IMM124E, ARAMCHOL™ (arachidyl amido cholanoic acid), GS0976, Emricasan, Volixibat, NGM282, GS9674, Tropifexor, MN_001, LMB763, BI_1467335, MSDC_0602, PF_05221304, DF102, Saroglitazar, BMS986036, Lanifibranor, Semaglutide, Nitazoxanide, GRI_0621, EYP001, VK2809, Nalmefene, LIK066, MT_3995, Elobixibat, Namodenoson, Foralumab, SAR425899, Sotagliflozin, EDP_305, Isosabutate, Gemcabene, TERN_101, KBP_042, PF_06865571, DUR928, PF_06835919, NGM313, BMS_986171, Namacizumab, CER_209, ND_L02_s0201, RTU_1096, DRX_065, IONIS_DGAT2Rx, INT_767, NC_001, Seladepar, PXL770, TERN_201, NV556, AZD2693, SP_1373, VK0214, Hepastem, TGFTX4, RLBN1127, GKT_137831, RYI_018, CB4209-CB4211, and JH_0920, or any combination thereof.

Administration of the CIDEB inhibitor, PNPLA3 inhibitor, or HSD17B13 inhibitor, or any combination thereof, and/or therapeutic agents that treat or inhibit a liver disease can be repeated, for example, after one day, two days, three days, five days, one week, two weeks, three weeks, one month, five weeks, six weeks, seven weeks, eight weeks, two months, or three months. The repeated administration can be at the same dose or at a different dose. The administration can be repeated once, twice, three times, four times, five times, six times, seven times, eight times, nine times, ten times, or more. For example, according to certain dosage regimens a subject can receive therapy for a prolonged period of time such as, for example, 6 months, 1 year, or more.

Administration of the CIDEB inhibitor, PNPLA3 inhibitor, or HSD17B13 inhibitor, or any combination thereof, and/or therapeutic agents that treat or inhibit a liver disease can occur by any suitable route including, but not limited to, parenteral, intravenous, oral, subcutaneous, intra-arterial, intracranial, intrathecal, intraperitoneal, topical, intranasal, or intramuscular. Pharmaceutical compositions for administration are desirably sterile and substantially isotonic and manufactured under GMP conditions. Pharmaceutical compositions can be provided in unit dosage form (i.e., the dosage for a single administration). Pharmaceutical compositions can be formulated using one or more physiologically and pharmaceutically acceptable carriers, diluents, excipients or auxiliaries. The formulation depends on the route of administration chosen. The term "pharmaceutically acceptable" means that the carrier, diluent, excipient, or auxiliary is compatible with the other ingredients of the formulation and not substantially deleterious to the recipient thereof.

In any of the embodiments described herein, the subject can have or be at risk of developing any one or more of the liver diseases described herein. In some embodiments, the subject is CIDEB reference. In some embodiments, the subject is heterozygous for a CIDEB variant nucleic acid molecule. In some embodiments, the subject is homozygous for a CIDEB variant nucleic acid molecule.

The present disclosure also provides methods of treating a subject, wherein the subject is overweight, obese, has increased body mass index (BMI), has high liver fat percentage, or has high adiposity, the methods comprising administering to the subject a CIDEB inhibitor in an amount that is the same as or greater than a standard dosage amount, or a CIDEB inhibitor in combination with a PNPLA3 inhibitor and/or an HSD17B13 inhibitor. In some embodiments, the subject is obese. In some embodiments, the subject is overweight. In some embodiments, the subject has increased BMI. In some embodiments, the subject has high adiposity.

The terms "treat", "treating", and "treatment" and "prevent", "preventing", and "prevention" as used herein, refer to eliciting the desired biological response, such as a therapeutic and prophylactic effect, respectively. In some embodiments, a therapeutic effect comprises one or more of a decrease and/or reduction in a liver disease, a decrease and/or reduction in the severity of a liver disease, a decrease and/or reduction in symptoms and liver disease-related effects, delaying the onset of symptoms and liver disease-related effects, reducing the severity of symptoms of liver disease-related effects, reducing the number of symptoms and liver disease-related effects, reducing the latency of symptoms and liver disease-related effects, an amelioration of symptoms and liver disease-related effects, reducing secondary symptoms, reducing secondary infections, preventing relapse to a liver disease, decreasing the number or frequency of relapse episodes, increasing latency between symptomatic episodes, increasing time to sustained progression, speeding recovery, or increasing efficacy of or decreasing resistance to alternative therapeutics, and/or an increased survival time of the affected host animal, following administration of the agent or composition comprising the agent. A prophylactic effect may comprise a complete or partial avoidance and/or inhibition or a delay of liver disease development and/or progression (such as, for example, a complete or partial avoidance/inhibition or a delay), and an increased survival time of the affected host animal, following administration of a therapeutic protocol. Treatment of liver disease encompasses the treatment of subjects already diagnosed as having any form of liver disease at any clinical stage or manifestation, the delay of the onset or evolution or aggravation or deterioration of the symptoms or signs of liver disease, and/or preventing and/or reducing the severity of a liver disease.

The present disclosure also provides methods of identifying a subject having an increased risk of developing a liver disease. In some embodiments, the methods comprise determining or having determined in a biological sample obtained from the subject the presence or absence of a CIDEB variant nucleic acid molecule (such as a genomic nucleic acid molecule, mRNA molecule, and/or cDNA molecule). When the subject lacks a CIDEB variant nucleic acid molecule (i.e., the subject is genotypically categorized as a CIDEB reference), then the subject has an increased risk of developing a liver disease. When the subject has a CIDEB variant nucleic acid molecule (i.e., the subject is heterozygous or homozygous for a CIDEB variant nucleic acid molecule), then the subject has a decreased risk of developing a liver disease compared to a subject who is CIDEB reference.

Having a single copy of a CIDEB variant nucleic acid molecule is more protective of a subject from developing a liver disease than having no copies of a CIDEB variant nucleic acid molecule. Without intending to be limited to any particular theory or mechanism of action, it is believed that a single copy of a CIDEB variant nucleic acid molecule (i.e., heterozygous for a CIDEB variant nucleic acid molecule) is protective of a subject from developing a liver disease, and it is also believed that having two copies of a CIDEB variant nucleic acid molecule (i.e., homozygous for a CIDEB variant nucleic acid molecule) may be more protective of a subject from developing a liver disease, relative to a subject with a single copy. Thus, in some embodiments, a single copy of a CIDEB variant nucleic acid molecule may not be completely protective, but instead, may be partially or incompletely protective of a subject from developing a liver disease. While not desiring to be bound by any particular theory, there may be additional factors or molecules involved in the development of a liver disease that are still present in a subject having a single copy of a CIDEB variant nucleic acid molecule, thus resulting in less than complete protection from the development of a liver disease.

Determining whether a subject has a CIDEB variant nucleic acid molecule in a biological sample from a subject and/or determining whether a subject has a CIDEB variant nucleic acid molecule can be carried out by any of the methods described herein. In some embodiments, these methods can be carried out in vitro. In some embodiments, these methods can be carried out in situ. In some embodiments, these methods can be carried out in vivo. In any of these embodiments, the nucleic acid molecule can be present within a cell obtained from the subject.

The present disclosure also provides methods of identifying a subject having an increased risk of developing a liver disease, such as fatty liver disease, parenchymal liver disease, liver cirrhosis, and/or fibrosis, wherein the methods comprise determining or having determined the subject's gene burden of having one or more CIDEB variant genomic nucleic acid molecules described herein, one or more CIDEB variant mRNA molecules described herein, or one or more variant cDNA molecules described herein, and/or one or more CIDEB predicted loss-of-function polypeptides or missense polypeptides described herein. The greater the gene burden the subject has, the lower the risk of developing a liver disease. The lower the gene burden the subject has, the greater the risk of developing a liver disease.

In some embodiments, the subject's gene burden of having a plurality of (or all) CIDEB variant nucleic acid molecules represents a weighted sum of a plurality of genetic variants associated with protection against developing a liver disease. In some embodiments, the gene burden is calculated using at least about 2, at least about 3, at least about 4, at least about 5, at least about 10, at least about 20, at least about 30, at least about 40, at least about 50, at least about 60, at least about 70, at least about 80, at least about 100, at least about 120, at least about 150, at least about 200, at least about 250, at least about 300, at least about 400, at least about 500, or at least about 1,000 genetic variants associated with liver disease. In some embodiments, when the subject has a gene burden greater than a threshold score, the subject has a decreased risk of developing a liver disease. In some embodiments, when the subject has a gene burden below a threshold score, the subject has an increased risk of developing a liver disease.

In some embodiments, the gene burden is determined by consideration of one or more, or each, of the following variants: 14:24305635:A:AGTAG, 14:24305641:A:C, 14:24305650:G:A, 14:24305657:C:A, 14:24305662:G:T, 14:24305667:T:C, 14:24305671:C:A, 14:24305671:C:G, 14:24305701:A:T, 14:24305709:C:T, 14:24305718:A:G, 14:24305721:T:C, 14:24305728:G:GGCCTT, 14:24305743:T:C, 14:24305948:T:C, 14:24305966:C:T, 14:24305974:T:C, 14:24305980:TCA:T, 14:24305988:C:T, 14:24306014:C:T, 14:24306034:A:C, 14:24306041:C:G, 14:24306044:G:A, 14:24306047:G:A, 14:24306051:T:G, 14:24306064:T:C, 14:24306074:A:G, 14:24306077:G:C, 14:24306082:A:G, 14:24306083:T:A, 14:24306095:G:A, 14:24306122:A:G, 14:24306134:C:G, 14:24306373:C:G, 14:24306379:T:C, 14:24306382:G:A, 14:24306383:G:T, 14:24306426:T:G, 14:24306437:C:G, 14:24306439:G:C, 14:24306442:A:G, 14:24306444:A:G, 14:24306457:C:T, 14:24306463:C:T, 14:24306469:C:T, 14:24306480:A:G, 14:24306486:A:C, 14:24306504:A:G, 14:24306519:A:G, 14:24307382:G:C, 14:24307405:A:G, 14:24307417:A:T, 14:24307421:T:A, 14:24307441:C:A, 14:24307444:A:C, 14:24307444:A:G, 14:24307450:C:CGCTG, 14:24307461:TG:T, 14:24307469:AG:A, 14:24307474:C:T, 14:24307475:A:G, 14:24307833:G:C, 14:24307851:T:TAC, 14:24306426:T:C, 14:24307849:G:C, 14:24307448:G:T, 14:24305671:C:T, 14:24305663:C:T, 14:24305686:C:G, 14:24307829:A:C, 14:24307818:CTGAG:C, 14:24307856:C:T, 14:24306423:T:C, 14:24306061:AC:A, 14:24307390:C:T, 14:24306382:G:T, 14:24306373:C:T, 14:24305733:T:C, 14:24307858:T:C, 14:24306387:C:T, 14:24305637:T:C, 14:24306062:C:T, 14:24307853:C:G, 14:24307450:C:G, 14:24306052:TG:T, 14:24305673:G:A, 14:24306043:C:T, 14:24307834:G:A, 14:24306417:C:T, 14:24307451:G:A, 14:24307436:A:C, 14:24305953:ACTTT:A, 14:24306489:G:T, 14:24307441:C:T, 14:24306375:C:T, 14:24305657:C:G, 14:24306427:C:T, 14:24306524:C:T, 14:24307516:C:A, 14:24307840:G:C, 14:24307501:A:G, 14:24305968:A:C, 14:24305986:C:T, 14:24307441:C:G, 14:24307459:G:T, 14:24306017:T:A, 14:24307424:G:A, 14:24306072:G:T, 14:24307423:C:T, 14:24307450:C:T, 14:24306420:G:A, 14:24307454:G:A, 14:24305653:C:T, 14:24307442:G:A, 14:24306002:C:T, 14:24306076:C:T, 14:24305664:C:T, 14:24305961:TG:T, 14:24305706:A:G, 14:24305946:C:T, 14:24306455:G:C, 14:24307468:G:A, 14:24307825:A:C, 14:24306110:G:A, 14:24305710:C:T, 14:24307483:C:T, 14:24306459:A:G, 14:24305754:C:T, 14:24305650:G:C, 14:24305691:C:T, 14:24306508:G:C, 14:24306039:G:T, 14:24306139:T:C, 14:24306391:T:C, 14:24306373:C:A, 14:24307498:C:T, 14:24307415:G:A, 14:24306138:CTG:C, 14:24307453:T:C, 14:24305692:G:A, 14:24305683:C:G, 14:24307484:G:A, 14:24307385:C:T, 14:24306519:A:T, 14:24307839:A:C, 14:24305965:C:T, 14:24305988:CAT:C, 14:24306087:C:G, 14:24307439:C:T, 14:24307477:A:C, 14:24306436:G:T, 14:24306507:A:G, 14:24307397:C:T, 14:24307495:G:A, 14:24306034:A:T, 14:24306013:G:A, 14:24307381:A:G, 14:24306383:G:C, 14:24305638:A:G, 14:24307420:G:A, 14:24306020:C:T, 14:24306470:A:C, 14:24307435:C:T, 14:24306469:C:G, 14:24306451:C:T, 14:24306403:G:A, 14:24307515:C:G, 14:24307489:A:G, 14:24307414:C:T, 14:24306483:A:G, 14:24305755:G:A, 14:24305766:C:T, 14:24306064:T:G, 14:24307516:C:G, 14:24305766:C:G, 14:24306489:G:A, 14:24306097:T:C, 14:24305763:T:G, 14:24307447:G:A, 14:24307402:G:A, 14:24305972:C:G, 14:24306423:T:G, 14:24305974:T:TG, 14:24307411:T:C, 14:24306121:T:C, 14:24307516:C:T, 14:24306424:C:T, 14:24306039:G:C, 14:24307853:C:A, 14:24306388:A:G, 14:24305990:T:C, 14:24307822:G:GT, 14:24305640:G:A, 14:24307418:T:C, 14:24305758:G:C, 14:24306131:C:T, 14:24305953:A:G, 14:24305730:C:A, 14:24306418:A:G, 14:24306059:AC:A, 14:24307842:G:A, 14:24307837:T:G, 14:24306095:G:T, 14:24306109:C:T, 14:24307822:G:A, 14:24306077:G:A, 14:24307824:A:T, 14:24306080:C:T, 14:24305649:C:T, 14:24306433:G:GA, 14:24306420:G:C, 14:24305658:T:G, 14:24306472:C:T, 14:24307412:TC:T, 14:24306062:C:A, 14:24306044:G:C, 14:24306047:G:T, 14:24306126:CAG:C, 14:24306449:C:G, 14:24307391:G:A, or 14:24307857:A:C (according to GRCh38/hg38 human genome assembly coordinates).

In some embodiments, the gene burden may be divided into quintiles, e.g., top quintile, intermediate quintile, and bottom quintile, wherein the top quintile of gene burden corresponds to the lowest risk group and the bottom quintile of gene burden corresponds to the highest risk group.

In some embodiments, when a subject is identified as having an increased risk of developing a liver disease, the subject is further treated with a therapeutic agent that treats or inhibits liver disease and/or a CIDEB inhibitor, as described herein. For example, when the subject is CIDEB reference, and therefore has an increased risk of developing a liver disease, the subject can be administered a CIDEB inhibitor in a standard dosage amount. In some embodiments, such a subject is also administered a therapeutic agent that treats or inhibits a liver disease. In some embodiments, when the subject is heterozygous for a CIDEB variant nucleic acid molecule, the subject is administered the CIDEB inhibitor in a dosage amount that is the same as or less than a standard dosage amount, and can also be administered a therapeutic agent that treats or inhibits a liver disease. In some embodiments, the subject is CIDEB reference. In some embodiments, the subject is heterozygous for a CIDEB variant nucleic acid molecule.

The present disclosure also provides, in any of the methods described herein, the detection or determination of the presence of a CIDEB variant genomic nucleic acid molecule, a CIDEB variant mRNA molecule, and/or a CIDEB variant cDNA molecule produced from an mRNA molecule in a biological sample from a subject. It is understood that gene sequences within a population and mRNA molecules encoded by such genes can vary due to polymorphisms such as single-nucleotide polymorphisms. The sequences provided herein for the CIDEB variant nucleic acid molecules disclosed herein are only exemplary sequences. Other sequences for the CIDEB variant nucleic acid molecules are also possible.

The present disclosure also provides, in any of the methods described herein, the detection or determination of the presence of a genomic nucleic acid molecule encoding a PNPLA3 Ile148Met polypeptide or a PNPLA3 Ile144Met polypeptide, an mRNA molecule encoding a PNPLA3 Ile148Met polypeptide or a PNPLA3 Ile144Met polypeptide, a cDNA molecule encoding a PNPLA3 Ile148Met polypeptide or a PNPLA3 Ile144Met polypeptide, and/or a PNPLA3 Ile148Met polypeptide or a PNPLA3 Ile144Met polypeptide in a biological sample from the subject. It is understood that gene sequences within a population and mRNA molecules encoded by such genes can vary due to polymorphisms such as single-nucleotide polymorphisms. The sequences provided herein for the PNPLA3 variant nucleic acid molecules disclosed herein are only exemplary sequences. Other sequences for the PNPLA3 variant nucleic acid molecules are also possible. The detection or determination of the presence of PNPLA3 variant nucleic acid molecules is described in, for example, U.S. Pat. No. 10,961,583.

The present disclosure also provides, in any of the methods described herein, the detection or determination of the presence of a genomic nucleic acid molecule encoding a reference HSD17B13 polypeptide or a functional HSD17B13 polypeptide, an mRNA molecule encoding a reference HSD17B13 polypeptide or a functional HSD17B13 polypeptide, a cDNA molecule encoding a reference HSD17B13 polypeptide or a functional HSD17B13 polypeptide, and/or a reference HSD17B13 polypeptide or a functional HSD17B13 polypeptide in a biological sample from the subject. It is understood that gene sequences within a population and mRNA molecules encoded by such genes can vary due to polymorphisms such as single-nucleotide polymorphisms. The sequences provided herein for the HSD17B13 variant nucleic acid molecules disclosed herein are only exemplary sequences. Other sequences for the HSD17B13 nucleic acid molecules are also possible. The detection or determination of the presence of HSD17B13 nucleic acid molecules is described in, for example, U.S. Pat. No. 10,961,583.

The biological sample can be derived from any cell, tissue, or biological fluid from the subject. The sample may comprise any clinically relevant tissue, such as a bone marrow sample, a tumor biopsy, a fine needle aspirate, or a sample of bodily fluid, such as blood, gingival crevicular fluid, plasma, serum, lymph, ascitic fluid, cystic fluid, or urine. In some cases, the sample comprises a buccal swab. The sample used in the methods disclosed herein will vary based on the assay format, nature of the detection method, and the tissues, cells, or extracts that are used as the sample. A biological sample can be processed differently depending on the assay being employed. For example, when detecting any of the nucleic acid molecules, preliminary processing designed to isolate or enrich the sample for the genomic DNA can be employed. A variety of known techniques may be used for this purpose. When detecting the presence of or level of any CIDEB, PNPLA3, and/or HSD17B13 mRNA molecule, different techniques can be used enrich the biological sample with mRNA. Various methods to detect the presence or level of a mRNA or the presence of a particular variant genomic DNA locus can be used.

In some embodiments, detecting a CIDEB variant nucleic acid molecule in a subject comprises assaying or performing a sequence analysis on a biological sample obtained from the subject to determine whether a CIDEB genomic nucleic acid molecule, a CIDEB mRNA molecule, or a CIDEB cDNA molecule produced from an mRNA molecule in the biological sample is a CIDEB variant nucleic acid molecule.

In some embodiments, the methods of detecting the presence or absence of a CIDEB variant nucleic acid molecule (such as, for example, a genomic nucleic acid molecule, an mRNA molecule, and/or a cDNA molecule) in a subject, comprise performing an assay on a biological sample obtained from the subject, which assay determines whether a nucleic acid molecule in the biological sample comprises a particular nucleotide sequence.

In some embodiments, detecting a nucleic acid molecule encoding a PNPLA3 Ile148Met or Ile144Met polypeptide in a subject comprises assaying or performing a sequence analysis on a biological sample obtained from the subject to determine whether a PNPLA3 genomic nucleic acid molecule, a PNPLA3 mRNA molecule, or a PNPLA3 cDNA molecule produced from an mRNA molecule in the biological sample encodes an Ile148Met or Ile144Met polypeptide.

In some embodiments, the methods of detecting the presence or absence of a nucleic acid molecule encoding a PNPLA3 Ile148Met or Ile144Met polypeptide (such as, for example, a genomic nucleic acid molecule, an mRNA molecule, and/or a cDNA molecule) in a subject, comprise performing an assay on a biological sample obtained from the subject, which assay determines whether a nucleic acid molecule in the biological sample comprises a particular nucleotide sequence.

In some embodiments, detecting a nucleic acid molecule encoding a reference HSD17B13 polypeptide or a functional HSD17B13 polypeptide comprises assaying or performing a sequence analysis on a biological sample obtained from the subject to determine whether a HSD17B13 genomic nucleic acid molecule, a HSD17B13 mRNA molecule, or a HSD17B13 cDNA molecule produced from an mRNA molecule in the biological sample encodes a reference HSD17B13 polypeptide or a functional HSD17B13 polypeptide.

In some embodiments, the methods of detecting the presence or absence of a nucleic acid molecule encoding a reference HSD17B13 polypeptide or a functional HSD17B13 polypeptide (such as, for example, a genomic nucleic acid molecule, an mRNA molecule, and/or a cDNA molecule) in a subject, comprise performing an assay on a biological sample obtained from the subject, which assay determines whether a nucleic acid molecule in the biological sample comprises a particular nucleotide sequence.

In some embodiments, the biological sample comprises a cell or cell lysate. Such methods can further comprise, for example, obtaining a biological sample from the subject comprising a CIDEB, PNPLA3, and/or HSD17B13 genomic nucleic acid molecule or mRNA molecule, and if mRNA, optionally reverse transcribing the mRNA into cDNA. Such assays can comprise, for example determining the identity of these positions of the particular, CIDEB, PNPLA3, and/or HSD17B13 nucleic acid molecule. In some embodiments, the method is an in vitro method.

In some embodiments, the determining step, detecting step, or sequence analysis comprises sequencing at least a portion of the nucleotide sequence of the CIDEB, PNPLA3, and/or HSD17B13 genomic nucleic acid molecule, the CIDEB, PNPLA3, and/or HSD17B13 mRNA molecule, or the CIDEB, PNPLA3, and/or HSD17B13 cDNA molecule produced from the mRNA molecule in the biological sample, wherein the sequenced portion comprises one or more variations that cause a loss-of-function or missense (partial or complete) or are predicted to cause a loss-of-function or missense (partial or complete), such as any one or more of the CIDEB, PNPLA3, and/or HSD17B13 nucleic acid molecules described herein.

In any of the methods described herein, the determining step, detecting step, or sequence analysis comprises sequencing at least a portion of the nucleotide sequence of the CIDEB or PNPLA3 nucleic acid molecule in the biological sample, wherein the sequenced portion comprises a position corresponding to a variant nucleic acid molecule position, wherein when a variant nucleotide at the variant nucleic acid molecule position is detected, the CIDEB or PNPLA3 nucleic acid molecule in the biological sample is a CIDEB or PNPLA3 variant nucleic acid molecule.

In some embodiments, the determining step, detecting step, or sequence analysis comprises: a) contacting the biological sample with a primer hybridizing to a portion of the nucleotide sequence of the CIDEB nucleic acid molecule that is proximate to a variant nucleic acid molecule position; b) extending the primer at least through the variant nucleic acid molecule position; and c) determining whether the extension product of the primer comprises a variant nucleotide at the variant nucleic acid molecule position.

In some embodiments, the assay comprises sequencing the entire nucleic acid molecule. In some embodiments, only a CIDEB genomic nucleic acid molecule is analyzed. In some embodiments, only a CIDEB mRNA is analyzed. In some embodiments, only a CIDEB cDNA obtained from CIDEB mRNA is analyzed.

In some embodiments, the determining step, detecting step, or sequence analysis comprises: a) amplifying at least a portion of the CIDEB nucleic acid molecule that encodes the CIDEB polypeptide, wherein the portion comprises a variant nucleic acid molecule position; b) labeling the amplified nucleic acid molecule with a detectable label; c) contacting the labeled nucleic acid molecule with a support comprising an alteration-specific probe, wherein the alteration-specific probe comprises a nucleotide sequence which hybridizes under stringent conditions to the variant nucleic acid molecule position; and d) detecting the detectable label.

In any of the methods described herein, the determining step, detecting step, or sequence analysis comprises sequencing at least a portion of the nucleotide sequence of the nucleotide sequence of the PNPLA3 genomic nucleic acid molecule in the biological sample, wherein the sequenced portion comprises a position corresponding to position 5109 according to SEQ ID NO:43 (i.e., the variant nucleic acid molecule position), or the complement thereof. In some embodiments, the sequence analysis comprises sequencing at least a portion of the nucleotide sequence of the PNPLA3 mRNA molecule in the biological sample, wherein the sequenced portion comprises a position corresponding to position 444 according to SEQ ID NO:46 (i.e., the variant nucleic acid molecule position), or the complement thereof; or position 432 according to SEQ ID NO:47 (i.e., the variant nucleic acid molecule position), or the complement thereof. In some embodiments, the sequence analysis comprises sequencing at least a portion of the nucleotide sequence of the PNPLA3 cDNA molecule in the biological sample, wherein the sequenced portion comprises a position corresponding to position 444 according to SEQ ID NO:50 (i.e., the variant nucleic acid molecule position), or the complement thereof; or position 432 according to SEQ ID NO:51 (i.e., the variant nucleic acid molecule position), or the complement thereof.

In some embodiments, the sequence analysis comprises: a) contacting the biological sample with a primer hybridizing to a portion of the nucleotide sequence of the PNPLA3 genomic nucleic acid molecule that is proximate to a position corresponding to position 5109 according to SEQ ID NO:43; b) extending the primer at least through the position of the nucleotide sequence of the PNPLA3 genomic nucleic acid molecule corresponding to position 5109 according to SEQ ID NO:43; and c) determining whether the extension product of the primer comprises a guanine at a position corresponding to position 5109 according to SEQ ID NO:43.

In some embodiments, the sequence analysis comprises: a) contacting the biological sample with a primer hybridizing to a portion of the nucleotide sequence of the PNPLA3 mRNA molecule that is proximate to a position corresponding to position 444 according to SEQ ID NO:46, or position 432 according to SEQ ID NO:47; b) extending the primer at least through the position of the nucleotide sequence of the PNPLA3 mRNA molecule corresponding to position 444 according to SEQ ID NO:46, or position 432 according to SEQ ID NO:47; and c) determining whether the extension product of the primer comprises a guanine at a position corresponding to position 444 according to SEQ ID NO:46, or a guanine at a position corresponding to position 432 according to SEQ ID NO:47.

In some embodiments, the sequence analysis comprises: a) contacting the biological sample with a primer hybridizing to a portion of the nucleotide sequence of the PNPLA3 cDNA molecule that is proximate to a position corresponding to position 444 according to SEQ ID NO:50, or position 432 according to SEQ ID NO:51; b) extending the primer at least through the position of the nucleotide sequence of the PNPLA3 cDNA molecule corresponding to position 444 according to SEQ ID NO:50, or position 432 according to SEQ ID NO:51; and c) determining whether the extension product of the primer comprises a guanine at a position corresponding to position 444 according to SEQ ID NO:50, or a guanine at a position corresponding to position 432 according to SEQ ID NO:51.

In some embodiments, the assay comprises sequencing the entire nucleic acid molecule. In some embodiments, only a PNPLA3 genomic nucleic acid molecule is analyzed. In some embodiments, only a PNPLA3 mRNA is analyzed. In some embodiments, only a PNPLA3 cDNA obtained from PNPLA3 mRNA is analyzed.

In some embodiments, the sequence analysis comprises: a) amplifying at least a portion of the nucleic acid molecule that encodes the PNPLA3 polypeptide, wherein the portion comprises a guanine at a position corresponding to position 5109 according to SEQ ID NO:43, or the complement thereof; b) labeling the amplified nucleic acid molecule with a detectable label; c) contacting the labeled nucleic acid molecule with a support comprising an alteration-specific probe, wherein the alteration-specific probe comprises a nucleotide sequence which hybridizes under stringent conditions to the nucleic acid sequence of the amplified nucleic acid molecule comprising a guanine at a position corresponding to position 5109 according to SEQ ID NO:43, or the complement thereof; and d) detecting the detectable label.

In some embodiments, the sequence analysis comprises: a) amplifying at least a portion of the nucleic acid molecule that encodes the PNPLA3 polypeptide, wherein the portion comprises a guanine at a position corresponding to position 444 according to SEQ ID NO:46, or the complement thereof; or a guanine at a position corresponding to position 432 according to SEQ ID NO:47, or the complement thereof; b) labeling the amplified nucleic acid molecule with a detectable label; c) contacting the labeled nucleic acid molecule with a support comprising an alteration-specific probe, wherein the alteration-specific probe comprises a nucleotide sequence which hybridizes under stringent conditions to the nucleic acid sequence of the amplified nucleic acid molecule comprising a guanine at a position corresponding to position 444 according to SEQ ID NO:46, or the complement thereof; or a guanine at a position corresponding to position 432 according to SEQ ID NO:47, or the complement thereof; and d) detecting the detectable label.

In some embodiments, the sequence analysis comprises: a) amplifying at least a portion of the nucleic acid molecule that encodes the PNPLA3 polypeptide, wherein the portion comprises a guanine at a position corresponding to position 444 according to SEQ ID NO:50, or the complement thereof; or a guanine at a position corresponding to position 432 according to SEQ ID NO:51, or the complement thereof; b) labeling the amplified nucleic acid molecule with a detectable label; c) contacting the labeled nucleic acid molecule with a support comprising an alteration-specific probe, wherein the alteration-specific probe comprises a nucleotide sequence which hybridizes under stringent conditions to the nucleic acid sequence of the amplified nucleic acid molecule comprising a guanine at a position corresponding to position 444 according to SEQ ID NO:50, or the complement thereof; or a guanine at a position corresponding to position 432 according to SEQ ID NO:51, or the complement thereof; and d) detecting the detectable label.

In any of the methods described herein, the determining step, detecting step, or sequence analysis comprises obtaining or having obtained a biological sample from the subject; and performing or having performed an assay on the biological sample to determine whether the subject has: i) an HSD17B13 genomic DNA comprising SEQ ID NO:52; or a nucleotide sequence having at least 90% sequence identity to SEQ ID NO:52 and encoding a reference HSD17B13 polypeptide or a functional HSD17B13 polypeptide; ii) an HSD17B13 mRNA comprising any one of SEQ ID NOs: 53-62, or a nucleotide sequence having at least 90% sequence identity to any one of SEQ ID NOs:53-62 and encoding a reference HSD17B13 polypeptide or a functional HSD17B13 polypeptide; or iii) an HSD17B13 cDNA comprising any one of SEQ ID NOs:63-72, or a nucleotide sequence having at least 90% sequence identity to any one SEQ ID NOs:63-72 and encoding a reference HSD17B13 polypeptide or a functional HSD17B13 polypeptide.

In some embodiments, the sequence analysis comprises sequencing at least a portion of the nucleotide sequence of the HSD17B13 genomic DNA, mRNA or cDNA produced from mRNA molecule in the biological sample.

In some embodiments, the nucleic acid molecule is mRNA and the determining step further comprises reverse-transcribing the mRNA into a cDNA prior to the amplifying step.

In some embodiments, the determining step, detecting step, or sequence analysis comprises: contacting the nucleic acid molecule in the biological sample with an alteration-specific probe comprising a detectable label, wherein the alteration-specific probe comprises a nucleotide sequence which hybridizes under stringent conditions to a variant nucleic acid molecule position; and detecting the detectable label.

The alteration-specific probes or alteration-specific primers described herein comprise a nucleic acid sequence which is complementary to and/or hybridizes, or specifically hybridizes, to a CIDEB variant nucleic acid molecule, or the complement thereof. In some embodiments, the alteration-specific probes or alteration-specific primers comprise or consist of at least about 1, at least about 5, at least about 8, at least about 10, at least about 11, at least about 12, at least about 13, at least about 14, at least about 15, at least about 16, at least about 17, at least about 18, at least about 19, at least about 20, at least about 21, at least about 22, at least about 23, at least about 24, at least about 25, at least about 30, at least about 35, at least about 40, at least about 45, or at least about 50 nucleotides. In some embodiments, the alteration-specific probes or alteration-specific primers comprise or consist of at least 15 nucleotides. In some embodiments, the alteration-specific probes or alteration-specific primers comprise or consist of at least 15 nucleotides to at least about 35 nucleotides. In some embodiments, alteration-specific probes or alteration-specific primers hybridize to CIDEB variant genomic nucleic acid molecules, CIDEB variant mRNA molecules, and/or CIDEB variant cDNA molecules under stringent conditions.

The alteration-specific probes or alteration-specific primers described herein comprise a nucleic acid sequence which is complementary to and/or hybridizes, or specifically hybridizes, to a nucleic acid molecule encoding a PNPLA3 Ile148Met or Ile144Met polypeptide, or the complement thereof. In some embodiments, the alteration-specific probes or alteration-specific primers comprise or consist of at least about 1, at least about 5, at least about 8, at least about 10, at least about 11, at least about 12, at least about 13, at least about 14, at least about 15, at least about 16, at least about 17, at least about 18, at least about 19, at least about 20, at least about 21, at least about 22, at least about 23, at least about 24, at least about 25, at least about 30, at least about 35, at least about 40, at least about 45, or at least about 50 nucleotides. In some embodiments, the alteration-specific probes or alteration-specific primers comprise or consist of at least 15 nucleotides. In some embodiments, the alteration-specific probes or alteration-specific primers comprise or consist of at least 15 nucleotides to at least about 35 nucleotides. In some embodiments, alteration-specific probes or alteration-specific primers hybridize to genomic nucleic acid molecules encoding a PNPLA3 Ile148Met or Ile144Met polypeptide, mRNA molecules encoding a PNPLA3 Ile148Met or Ile144Met polypeptide, and/or cDNA molecules encoding a PNPLA3 Ile148Met or Ile144Met polypeptide under stringent conditions.

Alteration-specific polymerase chain reaction techniques can be used to detect mutations such as SNPs in a nucleic acid sequence. Alteration-specific primers can be used because the DNA polymerase will not extend when a mismatch with the template is present.

In some embodiments, the nucleic acid molecule in the sample is mRNA and the mRNA is reverse-transcribed into a cDNA prior to the amplifying step. In some embodiments, the nucleic acid molecule is present within a cell obtained from the subject.

In some embodiments, the assay comprises contacting the biological sample with a primer or probe, such as an alteration-specific primer or alteration-specific probe, that specifically hybridizes to a CIDEB variant genomic sequence, variant mRNA sequence, or variant cDNA sequence and not the corresponding CIDEB reference sequence under stringent conditions, and determining whether hybridization has occurred.

In some embodiments, the assay comprises contacting the biological sample with a primer or probe, such as an alteration-specific primer or alteration-specific probe, that specifically hybridizes to genomic nucleic acid molecules encoding a PNPLA3 Ile148Met or Ile144Met polypeptide, mRNA molecules encoding a PNPLA3 Ile148Met or Ile144Met polypeptide, and/or cDNA molecules encoding a PNPLA3 Ile148Met or Ile144Met polypeptide under stringent conditions, and determining whether hybridization has occurred.

In some embodiments, the assay comprises RNA sequencing (RNA-Seq). In some embodiments, the assays also comprise reverse transcribing mRNA into cDNA, such as by the reverse transcriptase polymerase chain reaction (RT-PCR).

In some embodiments, the methods utilize probes and primers of sufficient nucleotide length to bind to the target nucleotide sequence and specifically detect and/or identify a polynucleotide comprising a CIDEB variant genomic nucleic acid molecule, a variant mRNA molecule, or a variant cDNA molecule, and/or a nucleic acid molecule encoding a PNPLA3 Ile148Met or Ile144Met polypeptide, an mRNA molecule encoding a PNPLA3 Ile148Met or Ile144Met polypeptide, and/or a cDNA molecule encoding a PNPLA3 Ile148Met or Ile144Met polypeptide. The hybridization conditions or reaction conditions can be determined by the operator to achieve this result. The nucleotide length may be any length that is sufficient for use in a detection method of choice, including any assay described or exemplified herein. Such probes and primers can hybridize specifically to a target nucleotide sequence under high stringency hybridization conditions. Probes and primers may have complete nucleotide sequence identity of contiguous nucleotides within the target nucleotide sequence, although probes differing from the target nucleotide sequence and that retain the ability to specifically detect and/or identify a target nucleotide sequence may be designed by conventional methods. Probes and primers can have about 80%, about 85%, about 90%, about 91%, about 92%, about 93%, about 94%, about 95%, about 96%, about 97%, about 98%, about 99%, or 100% sequence identity or complementarity with the nucleotide sequence of the target nucleic acid molecule.

Illustrative examples of nucleic acid sequencing techniques include, but are not limited to, chain terminator (Sanger) sequencing and dye terminator sequencing. Other methods involve nucleic acid hybridization methods other than sequencing, including using labeled primers or probes directed against purified DNA, amplified DNA, and fixed cell preparations (fluorescence in situ hybridization (FISH)). In some methods, a target nucleic acid molecule may be amplified prior to or simultaneous with detection. Illustrative examples of nucleic acid amplification techniques include, but are not limited to, polymerase chain reaction (PCR), ligase chain reaction (LCR), strand displacement amplification (SDA), and nucleic acid sequence based amplification (NASBA). Other methods include, but are not limited to, ligase chain reaction, strand displacement amplification, and thermophilic SDA (tSDA).

In hybridization techniques, stringent conditions can be employed such that a probe or primer will specifically hybridize to its target. In some embodiments, a polynucleotide primer or probe under stringent conditions will hybridize to its target sequence to a detectably greater degree than to other non-target sequences, such as, at least 2-fold, at least 3-fold, at least 4-fold, or more over background, including over 10-fold over background. Stringent conditions are sequence-dependent and will be different in different circumstances.

Appropriate stringency conditions which promote DNA hybridization, for example, 6× sodium chloride/sodium citrate (SSC) at about 45° C., followed by a wash of 2×SSC at 50° C., are known or can be found in *Current Protocols in Molecular Biology*, John Wiley & Sons, N.Y. (1989), 6.3.1-6.3.6. Typically, stringent conditions for hybridization and detection will be those in which the salt concentration is less than about 1.5 M $Na^+$ ion, typically about 0.01 to 1.0 M $Na^+$ ion concentration (or other salts) at pH 7.0 to 8.3 and the temperature is at least about 30° C. for short probes (such as, for example, 10 to 50 nucleotides) and at least about 60° C. for longer probes (such as, for example, greater than 50 nucleotides). Stringent conditions may also be achieved with the addition of destabilizing agents such as formamide. Optionally, wash buffers may comprise about 0.1% to about 1% SDS. Duration of hybridization is generally less than about 24 hours, usually about 4 to about 12 hours. The duration of the wash time will be at least a length of time sufficient to reach equilibrium.

In some embodiments, detecting the presence of a predicted loss-of-function polypeptide or missense polypeptide comprises performing an assay on a sample obtained from a subject to determine whether a CIDEB polypeptide in the subject contains one or more variations that causes the polypeptide to have a loss-of-function (partial or complete) or predicted loss-of-function (partial or complete) or missense variant. In some embodiments, the assay comprises sequencing at least a portion of the CIDEB polypeptide that comprises a variant position. In some embodiments, the detecting step comprises sequencing the entire polypeptide. Identification of a variant amino acid at the variant position of the CIDEB polypeptide indicates that the CIDEB polypeptide is a predicted loss-of-function or missense CIDEB polypeptide. In some embodiments, the assay comprises an immunoassay for detecting the presence of a polypeptide that comprises a variant. Detection of a variant amino acid at the variant position of the CIDEB polypeptide indicates that the CIDEB polypeptide is a CIDEB predicted loss-of-function or missense polypeptide.

In some embodiments, detecting the presence of a PNPLA3 Ile148Met or Ile144Met polypeptide comprises performing an assay on a sample obtained from a subject to determine whether a PNPLA3 polypeptide in the subject contains the Ile148Met or Ile144Met variation. In some embodiments, the assay comprises sequencing at least a portion of the PNPLA3 polypeptide that comprises a variant position. In some embodiments, the detecting step comprises sequencing the entire polypeptide. In some embodiments, the assay comprises an immunoassay for detecting the presence of a polypeptide that comprises a variant.

In some embodiments, isolated nucleic acid molecules hybridize to CIDEB variant nucleic acid molecules, nucleic acid molecules encoding a PNPLA3 Ile148Met or Ile144Met polypeptide, or nucleic acid molecules encoding a reference HSD17B13 polypeptide or a functional HSD17B13 polypeptide (such as genomic nucleic acid molecules, mRNA molecules, and/or cDNA molecules) under stringent conditions. Such nucleic acid molecules can be used, for example, as probes, primers, alteration-specific probes, or alteration-specific primers as described or exemplified herein, and include, without limitation primers, probes, antisense RNAs, shRNAs, and siRNAs, each of which is described in more detail elsewhere herein, and can be used in any of the methods described herein.

In some embodiments, the isolated nucleic acid molecules hybridize to at least about 15 contiguous nucleotides of a nucleic acid molecule that is at least about 70%, at least about 75%, at least about 80%, at least about 85%, at least about 90%, at least about 95%, at least about 96%, at least about 97%, at least about 98%, at least about 99%, or 100% identical to CIDEB variant genomic nucleic acid molecules, CIDEB variant mRNA molecules, and/or CIDEB variant cDNA molecules.

In some embodiments, the isolated nucleic acid molecules hybridize to at least about 15 contiguous nucleotides of a nucleic acid molecule that is at least about 70%, at least about 75%, at least about 80%, at least about 85%, at least about 90%, at least about 95%, at least about 96%, at least about 97%, at least about 98%, at least about 99%, or 100% identical to PNPLA3 genomic nucleic acid molecules encoding a PNPLA3 Ile148Met or Ile144Met polypeptide, PNPLA3 mRNA molecules encoding a PNPLA3 Ile148Met or Ile144Met polypeptide, and/or PNPLA3 cDNA molecules encoding a PNPLA3 Ile148Met or Ile144Met polypeptide.

In some embodiments, the isolated nucleic acid molecules hybridize to at least about 15 contiguous nucleotides of a nucleic acid molecule that is at least about 70%, at least about 75%, at least about 80%, at least about 85%, at least about 90%, at least about 95%, at least about 96%, at least about 97%, at least about 98%, at least about 99%, or 100% identical to HSD17B13 genomic nucleic acid molecules encoding a reference HSD17B13 polypeptide or a functional HSD17B13 polypeptide, HSD17B13 mRNA molecules encoding a reference HSD17B13 polypeptide or a functional HSD17B13 polypeptide, and/or HSD17B13 cDNA molecules encoding a reference HSD17B13 polypeptide or a functional HSD17B13 polypeptide. In some embodiments, the isolated nucleic acid molecules consist of or comprise from about 15 to about 100 nucleotides, or from about 15 to about 35 nucleotides. In some embodiments, the isolated nucleic acid molecules consist of or comprise from about 15 to about 100 nucleotides. In some embodiments, the isolated nucleic acid molecules consist of or comprise from about 15 to about 35 nucleotides.

In some embodiments, the alteration-specific probes and alteration-specific primers comprise DNA. In some embodiments, the alteration-specific probes and alteration-specific primers comprise RNA.

In some embodiments, the probes and primers described herein (including alteration-specific probes and alteration-specific primers) have a nucleotide sequence that specifically hybridizes to any of the nucleic acid molecules disclosed herein, or the complement thereof. In some embodiments, the probes and primers specifically hybridize to any of the nucleic acid molecules disclosed herein under stringent conditions.

In some embodiments, the primers, including alteration-specific primers, can be used in second generation sequencing or high throughput sequencing. In some instances, the primers, including alteration-specific primers, can be modified. In particular, the primers can comprise various modifications that are used at different steps of, for example, Massive Parallel Signature Sequencing (MPSS), Polony sequencing, and 454 Pyrosequencing. Modified primers can be used at several steps of the process, including biotinylated primers in the cloning step and fluorescently labeled primers used at the bead loading step and detection step. Polony sequencing is generally performed using a paired-end tags library wherein each molecule of DNA template is about 135 bp in length. Biotinylated primers are used at the bead loading step and emulsion PCR. Fluorescently labeled degenerate nonamer oligonucleotides are used at the detection step. An adaptor can contain a 5'-biotin tag for immobilization of the DNA library onto streptavidin-coated beads.

The probes and primers described herein can also be used to detect a nucleotide variation within any of the CIDEB variant genomic nucleic acid molecules, CIDEB variant mRNA molecules, and/or CIDEB variant cDNA molecules disclosed herein. The primers described herein can be used to amplify CIDEB variant genomic nucleic acid molecules, CIDEB variant mRNA molecules, or CIDEB variant cDNA molecules, or a fragment thereof.

In some embodiments, the probes (such as, for example, an alteration-specific probe) comprise a label. In some embodiments, the label is a fluorescent label, a radiolabel, or biotin.

The present disclosure also provides supports comprising a substrate to which any one or more of the probes disclosed herein is attached. Solid supports are solid-state substrates or supports with which molecules, such as any of the probes disclosed herein, can be associated. A form of solid support is an array. Another form of solid support is an array detector. An array detector is a solid support to which multiple different probes have been coupled in an array, grid, or other organized pattern. A form for a solid-state substrate is a microtiter dish, such as a standard 96-well type. In some embodiments, a multiwell glass slide can be employed that normally contains one array per well.

The present disclosure also provides therapeutic compositions that treat or inhibit a liver disease for use in the treatment of a liver disease in a subject having one or more CIDEB variant nucleic acid molecules comprising: 14:24305635:A:AGTAG, 14:24305641:A:C, 14:24305650:G:A, 14:24305657:C:A, 14:24305662:G:T, 14:24305667:T:C, 14:24305671:C:A, 14:24305671:C:G, 14:24305701:A:T, 14:24305709:C:T, 14:24305718:A:G, 14:24305721:T:C, 14:24305728:G:GGCCTT, 14:24305743:T:C, 14:24305948:T:C, 14:24305966:C:T, 14:24305974:T:C, 14:24305980:TCA:T, 14:24305988:C:T, 14:24306014:C:T, 14:24306034:A:C, 14:24306041:C:G, 14:24306044:G:A, 14:24306047:G:A, 14:24306051:T:G, 14:24306064:T:C, 14:24306074:A:G, 14:24306077:G:C, 14:24306082:A:G, 14:24306083:T:A, 14:24306095:G:A, 14:24306122:A:G, 14:24306134:C:G, 14:24306373:C:G, 14:24306379:T:C, 14:24306382:G:A, 14:24306383:G:T, 14:24306426:T:G, 14:24306437:C:G, 14:24306439:G:C, 14:24306442:A:G, 14:24306444:A:G, 14:24306457:C:T, 14:24306463:C:T, 14:24306469:C:T, 14:24306480:A:G, 14:24306486:A:C, 14:24306504:A:G, 14:24306519:A:G, 14:24307382:G:C, 14:24307405:A:G, 14:24307417:A:T, 14:24307421:T:A, 14:24307441:C:A, 14:24307444:A:C, 14:24307444:A:G, 14:24307450:C:CGCTG, 14:24307461:TG:T, 14:24307469:AG:A, 14:24307474:C:T, 14:24307475:A:G, 14:24307833:G:C, 14:24307851:T:TAC, 14:24306426:T:C, 14:24307849:G:C, 14:24307448:G:T, 14:24305671:C:T, 14:24305663:C:T, 14:24305686:C:G, 14:24307829:A:C, 14:24307818:CTGAG:C, 14:24307856:C:T, 14:24306423:T:C, 14:24306061:AC:A, 14:24307390:C:T, 14:24306382:G:T, 14:24306373:C:T, 14:24305733:T:C, 14:24307858:T:C, 14:24306387:C:T, 14:24305637:T:C, 14:24306062:C:T, 14:24307853:C:G, 14:24307450:C:G, 14:24306052:TG:T, 14:24305673:G:A, 14:24306043:C:T, 14:24307834:G:A, 14:24306417:C:T, 14:24307451:G:A, 14:24307436:A:C, 14:24305953:ACTTT:A, 14:24306489:G:T, 14:24307441:C:T, 14:24306375:C:T, 14:24305657:C:G, 14:24306427:C:T, 14:24306524:C:T, 14:24307516:C:A, 14:24307840:G:C, 14:24307501:A:G, 14:24305968:A:C, 14:24305986:C:T, 14:24307441:C:G, 14:24307459:G:T, 14:24306017:T:A, 14:24307424:G:A, 14:24306072:G:T, 14:24307423:C:T, 14:24307450:C:T, 14:24306420:G:A, 14:24307454:G:A, 14:24305653:C:T, 14:24307442:G:A, 14:24306002:C:T, 14:24306076:C:T, 14:24305664:C:T, 14:24305961:TG:T, 14:24305706:A:G, 14:24305946:C:T, 14:24306455:G:C, 14:24305468:G:A, 14:24307825:A:C, 14:24306110:G:A, 14:24305710:C:T, 14:24307483:C:T, 14:24306459:A:G, 14:24305754:C:T, 14:24305650:G:C, 14:24305691:C:T, 14:24306508:G:C, 14:24306039:G:T, 14:24306139:T:C, 14:24306391:T:C, 14:24306373:C:A, 14:24307498:C:T, 14:24307415:G:A, 14:24306138:CTG:C, 14:24307453:T:C, 14:24305692:G:A, 14:24305683:C:G, 14:24307484:G:A, 14:24307385:C:T, 14:24306519:A:T, 14:24307839:A:C, 14:24305965:C:T, 14:24305988:CAT:C, 14:24306087:C:G, 14:24307439:C:T, 14:24307477:A:C, 14:24306436:G:T, 14:24306507:A:G, 14:24307397:C:T, 14:24307495:G:A, 14:24306034:A:T, 14:24306013:G:A, 14:24307381:A:G, 14:24306383:G:C, 14:24305638:A:G, 14:24307420:G:A, 14:24306020:C:T, 14:24306470:A:C, 14:24307435:C:T, 14:24306469:C:G, 14:24306451:C:T, 14:24306403:G:A, 14:24307515:C:G, 14:24307489:A:G, 14:24307414:C:T, 14:24306483:A:G, 14:24305755:G:A, 14:24305766:C:T, 14:24306064:T:G, 14:24307516:C:G, 14:24305766:C:G, 14:24306489:G:A, 14:24306097:T:C, 14:24305763:T:G, 14:24307447:G:A, 14:24307402:G:A, 14:24305972:C:G, 14:24306423:T:G, 14:24305974:T:TG, 14:24307411:T:C, 14:24306121:T:C, 14:24307516:C:T, 14:24306424:C:T, 14:24306039:G:C, 14:24307853:C:A, 14:24306388:A:G, 14:24305990:T:C, 14:24307822:G:GT, 14:24305640:G:A, 14:24307418:T:C, 14:24305758:G:C, 14:24306131:C:T, 14:24305953:A:G, 14:24305730:C:A, 14:24306418:A:G, 14:24306059:AC:A, 14:24307842:G:A, 14:24307837:T:G, 14:24306095:G:T, 14:24306109:C:T, 14:24307822:G:A, 14:24306077:G:A, 14:24307824:A:T, 14:24306080:C:T, 14:24305649:C:T, 14:24306433:G:GA, 14:24306420:G:C, 14:24305658:T:G, 14:24306472:C:T, 14:24307412:TC:T, 14:24306062:C:A, 14:24306044:G:C, 14:24306047:G:T, 14:24306126:CAG:C, 14:24306449:C:G, 14:24307391:G:A, or 14:24307857:A:C (according to GRCh38/hg38 human genome assembly coordinates).

The present disclosure also provides compositions comprising therapeutic agents that treat or inhibit a liver disease for use in the preparation of a medicament for treatment of a liver disease in a subject having one or more CIDEB variant nucleic acid molecules comprising: 14:24305635:A:AGTAG, 14:24305641:A:C, 14:24305650:G:A, 14:24305657:C:A, 14:24305662:G:T, 14:24305667:T:C, 14:24305671:C:A, 14:24305671:C:G, 14:24305701:A:T, 14:24305709:C:T, 14:24305718:A:G, 14:24305721:T:C, 14:24305728:G:GGCCTT, 14:24305743:T:C, 14:24305948:T:C, 14:24305966:C:T, 14:24305974:T:C, 14:24305980:TCA:T, 14:24305988:C:T, 14:24306014:C:T, 14:24306034:A:C, 14:24306041:C:G, 14:24306044:G:A, 14:24306047:G:A, 14:24306051:T:G, 14:24306064:T:C, 14:24306074:A:G, 14:24306077:G:C, 14:24306082:A:G, 14:24306083:T:A, 14:24306095:G:A, 14:24306122:A:G, 14:24306134:C:G, 14:24306373:C:G, 14:24306379:T:C, 14:24306382:G:A, 14:24306383:G:T, 14:24306426:T:G, 14:24306437:C:G, 14:24306439:G:C, 14:24306442:A:G, 14:24306444:A:G, 14:24306457:C:T, 14:24306463:C:T, 14:24306469:C:T, 14:24306480:A:G, 14:24306486:A:C, 14:24306504:A:G, 14:24306519:A:G, 14:24307382:G:C, 14:24307405:A:G, 14:24307417:A:T, 14:24307421:T:A, 14:24307441:C:A, 14:24307444:A:C, 14:24307444:A:G, 14:24307450:C:CGCTG, 14:24307461:TG:T, 14:24307469:AG:A, 14:24307474:C:T, 14:24307475:A:G, 14:24307833:G:C, 14:24307851:T:TAC, 14:24306426:T:C, 14:24307849:G:C, 14:24307448:G:T, 14:24305671:C:T, 14:24305663:C:T, 14:24305686:C:G, 14:24307829:A:C, 14:24307818:CTGAG:C, 14:24307856:C:T, 14:24306423:T:C, 14:24306061:AC:A, 14:24307390:C:T, 14:24306382:G:T, 14:24306373:C:T, 14:24305733:T:C, 14:24307858:T:C, 14:24306387:C:T, 14:24305637:T:C, 14:24306062:C:T, 14:24307853:C:G, 14:24307450:C:G, 14:24306052:TG:T, 14:24305673:G:A, 14:24306043:C:T, 14:24307834:G:A, 14:24306417:C:T, 14:24307451:G:A, 14:24307436:A:C, 14:24305953:ACTTT:A, 14:24306489:G:T, 14:24307441:C:T, 14:24306375:C:T, 14:24305657:C:G, 14:24306427:C:

T, 14:24306524:C:T, 14:24307516:C:A, 14:24307840:G:C, 14:24307501:A:G, 14:24305968:A:C, 14:24305986:C:T, 14:24307441:C:G, 14:24307459:G:T, 14:24306017:T:A, 14:24307424:G:A, 14:24306072:G:T, 14:24307423:C:T, 14:24307450:C:T, 14:24306420:G:A, 14:24307454:G:A, 14:24305653:C:T, 14:24307442:G:A, 14:24306002:C:T, 14:24306076:C:T, 14:24305664:C:T, 14:24305961:TG:T, 14:24305706:A:G, 14:24305946:C:T, 14:24306455:G:C, 14:24307468:G:A, 14:24307825:A:C, 14:24306110:G:A, 14:24305710:C:T, 14:24307483:C:T, 14:24306459:A:G, 14:24305754:C:T, 14:24305650:G:C, 14:24305691:C:T, 14:24306508:G:C, 14:24306039:G:T, 14:24306139:T:C, 14:24306391:T:C, 14:24306373:C:A, 14:24307498:C:T, 14:24307415:G:A, 14:24306138:CTG:C, 14:24307453:T:C, 14:24305692:G:A, 14:24305683:C:G, 14:24307484:G:A, 14:24307385:C:T, 14:24306519:A:T, 14:24307839:A:C, 14:24305965:C:T, 14:24305988:CAT:C, 14:24306087:C:G, 14:24307439:C:T, 14:24307477:A:C, 14:24306436:G:T, 14:24306507:A:G, 14:24307397:C:T, 14:24307495:G:A, 14:24306034:A:T, 14:24306013:G:A, 14:24307381:A:G, 14:24306383:G:C, 14:24305638:A:G, 14:24307420:G:A, 14:24306020:C:T, 14:24306470:A:C, 14:24307435:C:T, 14:24306469:C:G, 14:24306451:C:T, 14:24306403:G:A, 14:24307515:C:G, 14:24307489:A:G, 14:24307414:C:T, 14:24306483:A:G, 14:24305755:G:A, 14:24305766:C:T, 14:24306064:T:G, 14:24307516:C:G, 14:24305766:C:G, 14:24306489:G:A, 14:24306097:T:C, 14:24305763:T:G, 14:24307447:G:A, 14:24307402:G:A, 14:24305972:C:G, 14:24306423:T:G, 14:24305974:T:TG, 14:24307411:T:C, 14:24306121:T:C, 14:24307516:C:T, 14:24306424:C:T, 14:24306039:G:C, 14:24307853:C:A, 14:24306388:A:G, 14:24305990:T:C, 14:24307822:G:GT, 14:24305640:G:A, 14:24307418:T:C, 14:24305758:G:C, 14:24306131:C:T, 14:24305953:A:G, 14:24305730:C:A, 14:24306418:A:G, 14:24306059:AC:A, 14:24307842:G:A, 14:24307837:T:G, 14:24306095:G:T, 14:24306109:C:T, 14:24307822:G:A, 14:24306077:G:A, 14:24307824:A:T, 14:24306080:C:T, 14:24305649:C:T, 14:24306433:G:GA, 14:24306420:G:C, 14:24305658:T:G, 14:24306472:C:T, 14:24307412:TC:T, 14:24306062:C:A, 14:24306044:G:C, 14:24306047:G:T, 14:24306126:CAG:C, 14:24306449:C:G, 14:24307391:G:A, or 14:24307857:A:C (according to GRCh38/hg38 human genome assembly coordinates).

The present disclosure also provides compositions comprising one or more CIDEB inhibitors, one or more PNPLA3 inhibitors, or one or more HSD17B13 inhibitors, or any combination thereof, for use in the treatment of a liver disease in a subject having one or more CIDEB variant nucleic acid molecules comprising: 14:24305635:A:AGTAG, 14:24305641:A:C, 14:24305650:G:A, 14:24305657:C:A, 14:24305662:G:T, 14:24305667:T:C, 14:24305671:C:A, 14:24305671:C:G, 14:24305701:A:T, 14:24305709:C:T, 14:24305718:A:G, 14:24305721:T:C, 14:24305728:G:GGCCTT, 14:24305743:T:C, 14:24305948:T:C, 14:24305966:C:T, 14:24305974:T:C, 14:24305980:TCA:T, 14:24305988:C:T, 14:24306014:C:T, 14:24306034:A:C, 14:24306041:C:G, 14:24306044:G:A, 14:24306047:G:A, 14:24306051:T:G, 14:24306064:T:C, 14:24306074:A:G, 14:24306077:G:C, 14:24306082:A:G, 14:24306083:T:A, 14:24306095:G:A, 14:24306122:A:G, 14:24306134:C:G, 14:24306373:C:G, 14:24306379:T:C, 14:24306382:G:A, 14:24306383:G:T, 14:24306426:T:G, 14:24306437:C:G, 14:24306439:G:C, 14:24306442:A:G, 14:24306444:A:G, 14:24306457:C:T, 14:24306463:C:T, 14:24306469:C:T, 14:24306480:A:G, 14:24306486:A:C, 14:24306504:A:G, 14:24306519:A:G, 14:24307382:G:C, 14:24307405:A:G, 14:24307417:A:T, 14:24307421:T:A, 14:24307441:C:A, 14:24307444:A:C, 14:24307444:A:G, 14:24307450:C:CGCTG, 14:24307461:TG:T, 14:24307469:AG:A, 14:24307474:C:T, 14:24307475:A:G, 14:24307833:G:C, 14:24307851:T:TAC, 14:24306426:T:C, 14:24307849:G:C, 14:24307448:G:T, 14:24305671:C:T, 14:24305663:C:T, 14:24305686:C:G, 14:24307829:A:C, 14:24307818:CTGAG:C, 14:24307856:C:T, 14:24306423:T:C, 14:24306061:AC:A, 14:24307390:C:T, 14:24306382:G:T, 14:24306373:C:T, 14:24305733:T:C, 14:24307858:T:C, 14:24306387:C:T, 14:24305637:T:C, 14:24306062:C:T, 14:24307853:C:G, 14:24307450:C:G, 14:24306052:TG:T, 14:24305673:G:A, 14:24306043:C:T, 14:24307834:G:A, 14:24306417:C:T, 14:24307451:G:A, 14:24307436:A:C, 14:24305953:ACTTT:A, 14:24306489:G:T, 14:24307441:C:T, 14:24306375:C:T, 14:24305657:C:G, 14:24306427:C:T, 14:24306524:C:T, 14:24307516:C:A, 14:24307840:G:C, 14:24307501:A:G, 14:24305968:A:C, 14:24305986:C:T, 14:24307441:C:G, 14:24307459:G:T, 14:24306017:T:A, 14:24307424:G:A, 14:24306072:G:T, 14:24307423:C:T, 14:24307450:C:T, 14:24306420:G:A, 14:24307454:G:A, 14:24305653:C:T, 14:24307442:G:A, 14:24306002:C:T, 14:24306076:C:T, 14:24305664:C:T, 14:24305961:TG:T, 14:24305706:A:G, 14:24305946:C:T, 14:24306455:G:C, 14:24307468:G:A, 14:24307825:A:C, 14:24306110:G:A, 14:24305710:C:T, 14:24307483:C:T, 14:24306459:A:G, 14:24305754:C:T, 14:24305650:G:C, 14:24305691:C:T, 14:24306508:G:C, 14:24306039:G:T, 14:24306139:T:C, 14:24306391:T:C, 14:24306373:C:A, 14:24307498:C:T, 14:24307415:G:A, 14:24306138:CTG:C, 14:24307453:T:C, 14:24305692:G:A, 14:24305683:C:G, 14:24307484:G:A, 14:24307385:C:T, 14:24306519:A:T, 14:24307839:A:C, 14:24305965:C:T, 14:24305988:CAT:C, 14:24306087:C:G, 14:24307439:C:T, 14:24307477:A:C, 14:24306436:G:T, 14:24306507:A:G, 14:24307397:C:T, 14:24307495:G:A, 14:24306034:A:T, 14:24306013:G:A, 14:24307381:A:G, 14:24306383:G:C, 14:24305638:A:G, 14:24307420:G:A, 14:24306020:C:T, 14:24306470:A:C, 14:24307435:C:T, 14:24306469:C:G, 14:24306451:C:T, 14:24306403:G:A, 14:24307515:C:G, 14:24307489:A:G, 14:24307414:C:T, 14:24306483:A:G, 14:24305755:G:A, 14:24305766:C:T, 14:24306064:T:G, 14:24307516:C:G, 14:24305766:C:G, 14:24306489:G:A, 14:24306097:T:C, 14:24305763:T:G, 14:24307447:G:A, 14:24307402:G:A, 14:24305972:C:G, 14:24306423:T:G, 14:24305974:T:TG, 14:24307411:T:C, 14:24306121:T:C, 14:24307516:C:T, 14:24306424:C:T, 14:24306039:G:C, 14:24307853:C:A, 14:24306388:A:G, 14:24305990:T:C, 14:24307822:G:GT, 14:24305640:G:A, 14:24307418:T:C, 14:24305758:G:C, 14:24306131:C:T, 14:24305953:A:G, 14:24305730:C:A, 14:24306418:A:G, 14:24306059:AC:A, 14:24307842:G:A, 14:24307837:T:G, 14:24306095:G:T, 14:24306109:C:T, 14:24307822:G:A, 14:24306077:G:A, 14:24307824:A:T, 14:24306080:C:T, 14:24305649:C:T, 14:24306433:G:GA, 14:24306420:G:C, 14:24305658:T:G, 14:24306472:C:T, 14:24307412:TC:T, 14:24306062:C:A, 14:24306044:G:C, 14:24306047:G:T, 14:24306126:CAG:C, 14:24306449:C:G, 14:24307391:G:A, or 14:24307857:A:C (according to GRCh38/hg38 human genome assembly coordinates). The CIDEB inhibitors, PNPLA3 inhibitors, and/or HSD17B13 inhibitors can be any of the CIDEB inhibitors, PNPLA3 inhibitors, and/or HSD17B13 inhibitors described herein.

The present disclosure also provides one or more CIDEB inhibitors, one or more PNPLA3 inhibitors, and/or one or more HSD17B13 inhibitors for use in the preparation of a medicament for treatment of a liver disease in a subject having one or more CIDEB variant nucleic acid molecules comprising: 14:24305635:A:AGTAG, 14:24305641:A:C, 14:24305650:G:A, 14:24305657:C:A, 14:24305662:G:T, 14:24305667:T:C, 14:24305671:C:A, 14:24305671:C:G, 14:24305701:A:T, 14:24305709:C:T, 14:24305718:A:G, 14:24305721:T:C, 14:24305728:G:GGCCTT, 14:24305743: T:C, 14:24305948:T:C, 14:24305966:C:T, 14:24305974:T: C, 14:24305980:TCA:T, 14:24305988:C:T, 14:24306014:C: T, 14:24306034:A:C, 14:24306041:C:G, 14:24306044:G:A, 14:24306047:G:A, 14:24306051:T:G, 14:24306064:T:C, 14:24306074:A:G, 14:24306077:G:C, 14:24306082:A:G, 14:24306083:T:A, 14:24306095:G:A, 14:24306122:A:G, 14:24306134:C:G, 14:24306373:C:G, 14:24306379:T:C, 14:24306382:G:A, 14:24306383:G:T, 14:24306426:T:G, 14:24306437:C:G, 14:24306439:G:C, 14:24306442:A:G, 14:24306444:A:G, 14:24306457:C:T, 14:24306463:C:T, 14:24306469:C:T, 14:24306480:A:G, 14:24306486:A:C, 14:24306504:A:G, 14:24306519:A:G, 14:24307382:G:C, 14:24307405:A:G, 14:24307417:A:T, 14:24307421:T:A, 14:24307441:C:A, 14:24307444:A:C, 14:24307444:A:G, 14:24307450:C:CGCTG, 14:24307461:TG:T, 14:24307469:AG:A, 14:24307474:C:T, 14:24307475:A:G, 14:24307833:G:C, 14:24307851:T:TAC, 14:24306426:T:C, 14:24307849:G:C, 14:24307448:G:T, 14:24305671:C:T, 14:24305663:C:T, 14:24305686:C:G, 14:24307829:A:C, 14:24307818:CTGAG:C, 14:24307856:C:T, 14:24306423: T:C, 14:24306061:AC:A, 14:24307390:C:T, 14:24306382: G:T, 14:24306373:C:T, 14:24305733:T:C, 14:24307858:T: C, 14:24306387:C:T, 14:24305637:T:C, 14:24306062:C:T, 14:24307853:C:G, 14:24307450:C:G, 14:24306052:TG:T, 14:24305673:G:A, 14:24306043:C:T, 14:24307834:G:A, 14:24306417:C:T, 14:24307451:G:A, 14:24307436:A:C, 14:24305953:ACTTT:A, 14:24306489:G:T, 14:24307441: C:T, 14:24306375:C:T, 14:24305657:C:G, 14:24306427:C: T, 14:24306524:C:T, 14:24307516:C:A, 14:24307840:G:C, 14:24307501:A:G, 14:24305968:A:C, 14:24305986:C:T, 14:24307441:C:G, 14:24307459:G:T, 14:24306017:T:A, 14:24307424:G:A, 14:24306072:G:T, 14:24307423:C:T, 14:24307450:C:T, 14:24306420:G:A, 14:24307454:G:A, 14:24305653:C:T, 14:24307442:G:A, 14:24306002:C:T, 14:24306076:C:T, 14:24305664:C:T, 14:24305961:TG:T, 14:24305706:A:G, 14:24305946:C:T, 14:24306455:G:C, 14:24307468:G:A, 14:24307825:A:C, 14:24306110:G:A, 14:24305710:C:T, 14:24307483:C:T, 14:24306459:A:G, 14:24305754:C:T, 14:24305650:G:C, 14:24305691:C:T, 14:24306508:G:C, 14:24306039:G:T, 14:24306139:T:C, 14:24306391:T:C, 14:24306373:C:A, 14:24307498:C:T, 14:24307415:G:A, 14:24306138:CTG:C, 14:24307453:T:C, 14:24305692:G:A, 14:24305683:C:G, 14:24307484:G:A, 14:24307385:C:T, 14:24306519:A:T, 14:24307839:A:C, 14:24305965:C:T, 14:24305988:CAT:C, 14:24306087:C:G, 14:24307439:C:T, 14:24307477:A:C, 14:24306436:G:T, 14:24306507:A:G, 14:24307397:C:T, 14:24307495:G:A, 14:24306034:A:T, 14:24306013:G:A, 14:24307381:A:G, 14:24306383:G:C, 14:24305638:A:G, 14:24307420:G:A, 14:24306020:C:T, 14:24306470:A:C, 14:24307435:C:T, 14:24306469:C:G, 14:24306451:C:T, 14:24306403:G:A, 14:24307515:C:G, 14:24307489:A:G, 14:24307414:C:T, 14:24306483:A:G, 14:24305755:G:A, 14:24305766:C:T, 14:24306064:T:G, 14:24307516:C:G, 14:24305766:C:G, 14:24306489:G:A, 14:24306097:T:C, 14:24305763:T:G, 14:24307447:G:A, 14:24307402:G:A, 14:24305972:C:G, 14:24306423:T:G, 14:24305974:T:TG, 14:24307411:T:C, 14:24306121:T:C, 14:24307516:C:T, 14:24306424:C:T, 14:24306039:G:C, 14:24307853:C:A, 14:24306388:A:G, 14:24305990:T:C, 14:24307822:G:GT, 14:24305640:G:A, 14:24307418:T:C, 14:24305758:G:C, 14:24306131:C:T, 14:24305953:A:G, 14:24305730:C:A, 14:24306418:A:G, 14:24306059:AC:A, 14:24307842:G:A, 14:24307837:T:G, 14:24306095:G:T, 14:24306109:C:T, 14:24307822:G:A, 14:24306077:G:A, 14:24307824:A:T, 14:24306080:C:T, 14:24305649:C:T, 14:24306433:G:GA, 14:24306420:G:C, 14:24305658:T:G, 14:24306472:C:T, 14:24307412:TC:T, 14:24306062:C:A, 14:24306044:G:C, 14:24306047:G:T, 14:24306126:CAG:C, 14:24306449:C:G, 14:24307391:G: A, or 14:24307857:A:C (according to GRCh38/hg38 human genome assembly coordinates). The CIDEB inhibitors, PNPLA3 inhibitors, and/or HSD17B13 inhibitors can be any of the CIDEB inhibitors, PNPLA3 inhibitors, and/or HSD17B13 inhibitors described herein.

The present disclosure also provides methods of treating a subject having a liver disease or at risk of developing a liver disease, wherein: when the subject is homozygous for a nucleic acid molecule encoding a reference HSD17B13 polypeptide or a functional HSD17B13 polypeptide, the subject is administered a CIDEB inhibitor in an amount that is the same as or greater than a standard dosage amount, or is administered a combination of a CIDEB inhibitor in an amount that is the same as or greater than a standard dosage amount and an HSD17B13 inhibitor and/or a PNPLA3 inhibitor; and when the subject is not homozygous for a nucleic acid molecule encoding a reference HSD17B13 polypeptide or a functional HSD17B13 polypeptide (i.e., is a carrier for a loss-of-function HSD17B13), the subject is administered a CIDEB inhibitor in an amount that is less than a standard dosage amount. The CIDEB inhibitors, PNPLA3 inhibitors, and/or HSD17B13 inhibitors can be any of the CIDEB inhibitors and/or HSD17B13 inhibitors described herein.

The present disclosure also provides methods of treating a subject with a CIDEB inhibitor, wherein the subject has a liver disease or is at risk of developing a liver disease, the methods comprising: determining whether the subject has a nucleic acid molecule encoding a reference HSD17B13 polypeptide or a functional HSD17B13 polypeptide by: obtaining or having obtained a biological sample from the subject; and performing or having performed a sequence analysis on the biological sample to determine if the subject has a genotype comprising the nucleic acid molecule encoding the reference HSD17B13 polypeptide or a functional HSD17B13 polypeptide; and when the subject is homozygous for a nucleic acid molecule encoding a reference HSD17B13 polypeptide or a functional HSD17B13 polypeptide, the subject is administered a CIDEB inhibitor in an amount that is the same as or greater than a standard dosage amount, or is administered a combination of a CIDEB inhibitor and an HSD17B13 inhibitor and/or a PNPLA3 inhibitor; and when the subject is not homozygous for a nucleic acid molecule encoding a reference HSD17B13 polypeptide or a functional HSD17B13 polypeptide (i.e., is a carrier for a loss-of-function HSD17B13), the subject is administered a CIDEB inhibitor in an amount that is less than a standard dosage amount; wherein the presence of a genotype having the nucleic acid molecule encoding the reference HSD17B13 polypeptide or a functional HSD17B13 polypeptide indicates the subject is a candidate for treatment with the CIDEB inhibitor.

All patent documents, websites, other publications, accession numbers and the like cited above or below are incorporated by reference in their entirety for all purposes to the same extent as if each individual item were specifically and individually indicated to be so incorporated by reference. If different versions of a sequence are associated with an accession number at different times, the version associated with the accession number at the effective filing date of this application is meant. The effective filing date means the earlier of the actual filing date or filing date of a priority application referring to the accession number if applicable. Likewise, if different versions of a publication, website or the like are published at different times, the version most recently published at the effective filing date of the application is meant unless otherwise indicated. Any feature, step, element, embodiment, or aspect of the present disclosure can be used in combination with any other feature, step, element, embodiment, or aspect unless specifically indicated otherwise. Although the present disclosure has been described in some detail by way of illustration and example for purposes of clarity and understanding, it will be apparent that certain changes and modifications may be practiced within the scope of the appended claims.

The following examples are provided to describe the embodiments in greater detail. They are intended to illustrate, not to limit, the claimed embodiments. The following examples provide those of ordinary skill in the art with a disclosure and description of how the compounds, compositions, articles, devices and/or methods described herein are made and evaluated, and are intended to be purely exemplary and are not intended to limit the scope of any claims. Efforts have been made to ensure accuracy with respect to numbers (such as, for example, amounts, temperature, etc.), but some errors and deviations may be accounted for. Unless indicated otherwise, parts are parts by weight, temperature is in ° C. or is at ambient temperature, and pressure is at or near atmospheric.

EXAMPLES

Example 1: General Methodology and Frequency of Rare Coding Variants in CIDEB Across Populations Study Participants Discovery exome-wide association analyses were performed in the UK Biobank (UKB) cohort and in the MyCode Community Health Initiative from Geisinger Health System (GHS). The UKB is a population-based cohort including individuals 40-69 years of age recruited at 22 testing sites in the UK between 2006-2010. 411,926 European ancestry, 9,830 South Asian ancestry, 8,544 African ancestry, 2,108 East Asian ancestry, and 587 American ancestry participants with available whole-exome sequencing and transaminase data were included. MyCode is a health system-based cohort of patients from rural Pennsylvania (USA) recruited in 2007-2021. 109,909 European ancestry participants with available whole-exome sequencing and transaminase data were included. Liver disease outcome association analyses further included up to 28,948 participants from the Malmö Diet and Cancer Study (MDCS). 13,418 participants from the University of Pennsylvania PennMedicine BioBank (UPENN-PMBB) and 23,849 participants from the Mount Sinai BioMe BioBank cohort (BioMe). Liver-histopathology association analyses were also performed in 3,599 bariatric surgery patients from GHS who were not included in the primary discovery analyses.

DNA Exome Sequencing

NimbleGen VCRome probes (for part of GHS) or a modified version of the xGen design available from Integrated DNA Technologies (IDT; for the rest of GHS and for other cohorts) were used to capture exome sequences. Following capture, balanced pools were sequenced using 75 bp paired-end reads on Illumina v4 HiSeq 2500 (for part of the GHS cohort) or NovaSeq (for the rest of GHS and for other cohorts) instruments. Sequencing achieved greater than 20× coverage over 85% of targeted bases in 96% of VCRome samples and 20× coverage over 90% of targeted bases in 99% of IDT samples. Following sequencing, pooled samples were demultiplexed using Illumina software, aligned sequenced reads to the GRCh38 Human Genome reference sequence using BWA-mem, and generated cohort-level genotype files with GLnexus.

Variants were annotated using the snpEff software and Ensembl v85 gene definitions. Annotations were prioritized for protein-coding transcripts based on the most deleterious functional effect for each gene based with the following hierarchy (from most to least deleterious): frameshift, stop-gain, stop-loss, splice acceptor, splice donor, in-frame indel, missense, other annotations. Predicted LOF genetic variants included: a) insertions or deletions resulting in a frameshift, b) insertions, deletions or single nucleotide variants resulting in the introduction of a premature stop codon or in the loss of the transcription start site or stop site, and c) variants in donor or acceptor splice sites. Missense variants were classified for likely functional impact according to the number of in silico prediction algorithms that predicted deleteriousness using SIFT, Polyphen2_HDIV and Polyphen2_HVAR, LRT and MutationTaster. For each gene, the alternative allele frequency (AAF) and functional annotation of each variant determined inclusion into these 7 gene burden exposures: 1) pLOF variants with AAF<1%; 2) pLOF or missense variants predicted deleterious by 5/5 algorithms with AAF<1%; 3) pLOF or missense variants predicted deleterious by 5/5 algorithms with AAF<0.1%; 4) pLOF or missense variants predicted deleterious by at least 1/5 algorithms with AAF<1%; 5) pLOF or missense variants predicted deleterious by at least 1/5 algorithms with AAF<0.1%; 6) pLOF or any missense with AAF<1%; 7) pLOF or any missense variants with AAF<0.1%.

Phenotype Definitions

For continuous traits, data cleaning was performed by removing non-physiologic lab values, or results stemming from invalid or contaminated specimens. In Geisinger Health System (GHS), the median transaminase values for each individual were extracted from electronic health records. In the UK Biobank (UKB), transaminases were measured using a Beckman Coulter AU5800 at the baseline study visit.

Cases of binary liver disease outcomes were defined based on one or more of the following criteria: i) self-reported disease obtained from digital questionnaire or interview with a trained nurse, ii) in-patient hospitalization for the disease or clinical-problem list entries of the disease according to International Classification of Diseases, Ninth (ICD-9) or Tenth (ICD-10) Revision diagnosis code, iii) medical procedures or surgery due to the disease, iv) death due to the disease, and v) a disease diagnosis code entered for two or more outpatient visits in separate calendar days. The specific entries used to define different types of liver disease are described in detail in Table 17. Controls were defined as individuals who did not meet any of the criteria for case status. To minimize misclassification, the following were excluded from the control group: i) non-cases diagnosed with any type of liver disease (not restricted to the type of liver disease in question), ii) non-cases with only one out-patient encounter related to the type of liver disease in question, iii) non-cases diagnosed with ascites presumably related to liver failure, and iv) non-cases with elevated alanine aminotransferase (ALT) levels (>33 IU/L for men, >25 IU/L for women).

TABLE 17

Definition of liver disease outcomes based on health surveys and electronic health records

| Liver disease outcome | Case definition |
| --- | --- |
| Liver disease (any) | ICD10: K70(Alcoholic liver disease), K71(Toxic liver disease), K72(Hepatic failure, not elsewhere classified), K73(Chronic hepatitis, not elsewhere classified), K74(Fibrosis and cirrhosis of liver), K75(Other inflammatory liver diseases), K76(Other diseases of liver), K77(Liver disorders in diseases classified elsewhere), I81(Portal vein thrombosis), I85(Secondary esophageal varices without bleeding), I982(Esophageal varices without bleeding in diseases classified elsewhere), I983(Esophageal varices with bleeding in diseases classified elsewhere), I864(Gastric varices), T864(Complications of liver transplant), Z944(Liver transplant status), C220(Liver cell carcinoma). Procedure codes according to OPCS4 classification: G10(Open operations on varices of esophagus), G144(Fiberoptic endoscopic injection sclerotherapy to varices of esophagus), J01(Transplantation of liver). Procedure codes according to NOMESCO classification version 1: JJC(liver transplant), JCA20(ligature of esophageal varices), JCA22(endoscopic ligature of esophageal varices), JDA22(endoscopic ligature of varices of stomach), TJC00(insertion of balloon tube for tamponade of esophageal varices [sengstaken-blakemore]). Procedure codes according to NOMESCO classification version 6: 5200(liver transplant), 5201(exploration of transplanted liver), 5212(resection of transplanted liver), 5214(extracorporeal resection of liver prior to transplant), 5219(other types of resection of transplanted liver), 5280(biopsy from transplanted liver), 5282(percutaneous liver biopsy from transplanted liver). Self-report: alcoholic liver disease, alcoholic cirrhosis, liver failure cirrhosis, esophageal varices. |
| Alcoholic liver disease | ICD10: K70(Alcoholic liver disease) |
| Non-alcoholic liver disease | ICD10: K721(Chronic hepatic failure), K740(Hepatic fibrosis), K741(Hepatic sclerosis), K742(Hepatic fibrosis with hepatic sclerosis), K746(Other and unspecified cirrhosis of liver), K758(Other specified inflammatory liver diseases), K760(Fatty [change of] liver, not elsewhere classified) |
| Liver cirrhosis (any) | ICD10: K703(Cirrhosis), K704(Alcoholic hepatic failure), K717(Toxic liver disease with fibrosis and cirrhosis of liver), K721(Chronic hepatic failure), K746(Other and unspecified cirrhosis of liver) |
| Alcoholic liver cirrhosis | ICD10: K703(Cirrhosis), K704(Alcoholic hepatic failure) |
| Non-alcoholic liver cirrhosis | ICD10: K746(Other and unspecified cirrhosis of liver) |
| Viral hepatitis | ICD10: B15(Acute hepatitis A), B16(Acute hepatitis B), B17(Other acute viral hepatitis), B18(Chronic viral hepatitis), B19(Unspecified viral hepatitis) |

ICD10 indicates the 10th revision of the International Statistical Classification of Diseases and Related Health Problems; OPCS4 indicates Office of Population Censuses and Surveys (OPCS) Classification of Interventions and Procedures version 4; NOMESCO indicates Nordic Medico-Statistical Committee procedure codes. Participants were excluded from the control population if they were: i) diagnosed with the "any liver disease" outcome codes (as defined in the table), ii) ascites presumably related to liver failure (ICD10 R18 (Ascites), excluding individuals with other potential causes of ascites; C16 (Malignant neoplasm of stomach), C17 (Malignant neoplasm of small intestine), C18 (Malignant neoplasm of colon), C20 (Malignant neoplasm of rectum), 142 (Cardiomyopathy),I50 (Heart failure)) or iii) if they had elevated ALT>33 U/L for men and >25 U/L for women.

Liver Histopathologic Phenotype Definitions in the GHS Bariatric Surgery Cohort

The GHS bariatric cohort consists of 3,599 individuals of European descent who underwent bariatric surgery and were enrolled in GHS's MyCode and GHS-Regeneron Genetics Center (RGC) DiscovEHR collaboration. Surgeons took wedge biopsies of the liver 10 cm to the left of falciform ligament prior to any liver retraction or surgery on the stomach, following a standardized protocol. The biopsy was divided into sections, with the primary section delivered to the clinical pathologists for liver histology (fixed in 10% neutral buffered formalin and stained with hematoxylin and eosin for routine histology and Masson's trichrome for assessment of fibrosis) and remaining sections stored within a research biobank (stabilized with the RNAlater tissue collection system (ThermoFisher Scientific) or frozen in liquid nitrogen). An experienced pathologist conducted histological examinations, which were subsequently re-reviewed by a second pathologist, and scored based on the NASH Clinical Research Network system: steatosis Grade 0 (<5% parenchymal involvement), Grade 1 (5 to <34%), Grade 2 (34 to <67%), and Grade 3 (>67%); lobular inflammation Grade 0 (no foci), Grade 1 (mild, <2 foci per 200× field), Grade 2 (moderate, 2-4 foci per 200× field), Grade 3 (severe, >4 foci per 200× field); ballooning Grade 0 (none), Grade 1 (few balloon cells), Grade 2 (many cells/prominent ballooning); fibrosis Stage 0 (none), Stage 1 (perisinusoidal or periportal fibrosis), Stage 2 (perisinusoidal and periportal fibrosis), Stage 3 (bridging fibrosis), and Stage 4 (liver cirrhosis). These histologic diagnoses were used to define the following phenotypes: 1) Normal liver: no evidence of steatosis, nonalcoholic steatohepatitis (NASH), or fibrosis; 2) Simple steatosis: Steatosis (regardless of grade) with no evidence of NASH or fibrosis; 3) NASH: Any presence of lobular inflammation or hepatocyte ballooning (regardless of grade), or any presence of fibrosis (regardless of stage); 4) Fibrosis: Any presence of fibrosis (regardless of stage); 5) Nonalcoholic fatty liver disease (NAFLD) activity score (NAS) defined as the unweighted sum of the scores for steatosis (0-3), lobular inflammation (0-3) and ballooning (0-2), thus ranging from 0-8.

Statistical Analysis

Associations between genotypes and phenotypes were estimated by fitting linear (for quantitative traits) or Firth bias-corrected logistic (for binary traits) regression models using REGENIE v2+(10.1038/s41588-021-00870-7) or the logistf function in R. Analyses were stratified by cohort and ancestry and adjusted for age, age$^2$, sex, age-by-sex and age$^2$-by-sex interaction terms, experimental batch-related covariates, the first 10 common variant-derived genetic principal components (PCs), the first 20 rare variant-derived PCs, and a polygenic score generated by REGENIE that accounts for relatedness, population structure, and polygenicity (10.1038/ng.257). To ensure independence between rare and common variants signals, discovery exome-wide analyses for common variant signals identified by fine-mapping were additionally adjusted as previously described. Results across studies were combined by fixed-effect inverse variance-weighted meta-analysis.

Frequency of CIDEB Coding Variants Identified by Exome Sequencing Across Ancestries Using exome sequencing across ancestry groups as described above, the frequency of homozygous reference genotype (reference-reference, RR), heterozygous alternative allele carrier genotype (reference-alternative, RA) and homozygous alternative allele carrier genotype (alternative-alternative, AA) were determined in sequenced individuals across ancestry groups. In each ancestry group, the RR genotype, which in the genetic analyses were associated with higher liver fat, injury and liver disease risk was the most common genotype (Table 18).

TABLE 18

Genotype frequencies for CIDEB predicted loss-of-function or missense variants identified by exome sequencing across ancestries

| Ancestry | RR genotype, % | RA genotype, % | AA genotype, % |
|---|---|---|---|
| African | 98.6% | 1.4% | 0.001% |
| American | 98.7% | 1.3% | 0.01% |
| European | 99.3% | 0.7% | 0.001% |

TABLE 18-continued

Genotype frequencies for CIDEB predicted loss-of-function or missense variants identified by exome sequencing across ancestries

| Ancestry | RR genotype, % | RA genotype, % | AA genotype, % |
|---|---|---|---|
| East Asian | 98.8% | 1.2% | 0% |
| South Asian | 97.8% | 2.2% | 0.02% |

Abbreviations:
RR, reference-reference genotype;
RA, reference-alternative genotype;
AA, alternative-alternative genotype for predicted loss-of-function or missense variants in CIDEB.
The sum of percentages may differ from 100% due to rounding.

GTEx RNA-seq

TMM normalized gene expression matrices per tissue were obtained using GTEx v8 raw expression matrices download from the GTEx portal. Within each tissue, we subset to samples included in the GTEx v8 analysis freeze and filter to genes using the same quality control filters described below.

Liver RNA-Seq in Bariatric Cohort Samples

Liver RNA-seq was performed in 2,304 patients from GHS who underwent a perioperative wedge biopsy of the liver as part of bariatric surgery.

RNA concentration was determined by UV absorbance and 500 ng of total RNA was used for processing. Samples were processed with the NEBNext Poly(A) mRNA Magnetic Isolation Module and NEB NEBNext Ultra II Directional RNA Library Prep Kit for Illumina (New England Biolabs), according to the manufacturer recommendations. Samples were amplified with 10 cycles of PCR with Kapa HiFi polymerase (Roche) and custom barcoded primers (IDT). Samples were sequenced on the Illumina NovaSeq 6000 platform on S2 flow cells with paired-end 75 bp reads. The mean number of reads per sample was 72 million and the median was 68 million; 93% of the samples had at least 50 million reads and 99% of the samples had more than 45 million reads, reflecting high coverage sequencing. The gene expression values for all samples were then normalized across samples using the trimmed mean of m-values approach (TMM) as implemented in edgeR.

RNA-seq data were processed broadly following the GTEx v8 analysis protocol (world wide web at gtexportal.ordhonne/documentationPage #staticTextAnalysisMethods). Briefly, sequenced samples were aligned to the human reference genome GRCh38/hg38 with STAR v2.5.3a. Duplicate marking was applied to optical duplicates only with Picard using the pixel distance setting OPTICAL_DUPLICATE_PIXEL_DISTANCE=15000.

The quantification of mRNA was based on the GENCODE Release 32 annotation (world wide web at gencodegenes.org/human/release_32.html), collapsed to a single transcript model for each gene. Gene-level expression quantification was performed using RNA-SeQC. Gene-level read counts and TPM values were produced using the following read-level filters: 1) reads were uniquely mapped; 2) reads were aligned in proper pairs; 3) the read alignment distance was 6; 4) reads were fully contained within exon boundaries.

Gene expression values for all samples were normalized: 1) read counts were normalized between samples using TMM; 2) genes were selected based on expression thresholds of ≥0.1 TPM in ≥20% of samples and reads (unnormalized) in ≥20% of samples.

Allele Specific Read Counts and Analyses

Read counts per allele generated by counting the number of reads overlapping the variant's position and carrying the allele of interest (reference or alternative). P-values for the observed degree of imbalance in read counts per allele were based on an exact binomial test as implemented in binom.test function in R version 4.0.5 assuming a 50% probability of success under the null.

CIDEB Knockdown in HepG2 Cells

HepG2 (ATCC) cells were cultured in MEM with Earle's salt supplemented with 10% FBS, 1% Penicillin-Streptomycin, and 1% L-glutamine. For siRNA knockdown, cells were transfected with CIDEB siRNA (Smartpool, Dharmacon L-004410-00-0050) or control siRNA (Non-targeting pool, Dharmacon D-001810-10-50) for 48 hours. For OA treatment, cells were treated with 400 μM OA for 24 hours, beginning 24 hours after transfection.

For localization of CIDEB with lipid droplets, cells were fixed in 3% PFA for 20 minutes then permeabilized in 0.1% saponin, blocked in 1% BSA and incubated overnight with primary antibody against CIDEB (1:1000, Abnova H00027141-M01). Alexa Fluor 594 goat anti-mouse IgG (Thermo) was used during the secondary antibody incubation. BODIPY493/503 was incubated for 1 hour during the secondary antibody incubation step followed by a 10-minute incubation with DAPI to stain nuclei. After washing, PBS was replaced with mounting medium for fluorescence microscopy (Ibidi 50001) then imaged using a Zeiss LSM 880 confocal microscope.

For western blotting, cells were lysed in RIPA lysis buffer plus protease and phosphatase inhibitors. Lysate was cleared, quantified, electrophoresed, and transferred to PVDF membranes. Membranes were blocked in Superblock T20 TBS buffer (Thermo 37536) then incubated in primary antibodies (CIDEB: Abnova H00027141-M01 1:1000; GAPDH: HRP-conjugated Sigma G9295). For CIDEB, bound antibody was detected via incubation with anti-mouse IgG, HRP secondary antibody (Cell Signaling 7076, 1:10000 dilution. Supersignal West Pico Plus Chemiluminescent Substrate (Thermo 4579) and Supersignal West Femto Maximum Sensitivity Substrate (Thermo 34094) were used for the development of chemiluminescent signal. Relative protein expression was determined by quantification of CIDEB and GAPDH bands on ImageJ. Data was normalized using GAPDH and control cells.

RNA isolation was performed using the RNeasy mini kit (QIAGEN 74104) with DNase I digestion (QIAGEN 79254) as per manufacturer's instructions. Total of 1 μg of RNA was used for cDNA synthesis using the SuperScript IV VILO cDNA synthesis kit (Thermo 11754050). Gene expression levels were determined using Taqman gene expression assays (Applied Biosystems assay IDs: CIDEB (Hs00205339_m1), GAPDH (Hs02786624_g1)) using the Taqman Fast Advanced Master Mix (Thermo 4444963) with the QuantStudio 6 instrument. The data was normalized using GAPDH and the control cells.

For lipid droplet visualization, cells were incubated with AdipoRed (Lonza PT-7009) for 10 minutes then fixed for 10 minutes in 4% paraformaldehyde (PFA). Cells were washed then incubated with 4',6-diamidino-2-phenylindole (DAPI) for 10 minutes to stain nuclei. After washing, PBS was replaced with mounting medium for fluorescence microscopy (Ibidi 50001) then imaged using a Zeiss LSM 880 confocal microscope.

For quantification of lipid droplets, lipid droplets were detected in the red channel (excitation at 485 nm and emission at 572 nm) using Laplacian-of-Gaussian blob detection, as implemented in the Scikit-Image Python package. To tune the detection threshold parameter of the blob detection algorithm, lipid droplets were manually marked for six random small regions (250×250 pixels) from three images per experimental group. The number of cells in each field was estimated from the DAPI channel. For each experimental group, the following quantitative endpoints were derived: average lipid droplet size (quantified as lipid droplet volumes), average number of lipid droplets per nucleus, and average cell lipid droplet staining (quantified as total lipid droplet areas per nucleus).

Levels of intracellular triglyceride content was measured using the Triglyceride Assay Kit (Abcam ab65336) according to manufacturer's instructions. Triglyceride content was normalized to total protein content as determined by the DC Protein assay (BioRad 5000111). IL8 protein concentrations in cell media were measured using a Meso Scale Diagnostics Proinflammatory Panel and were normalized to total protein content.

Two-way analysis of variation (ANOVA) was used to determine if an interaction between the effects of oleic acid and CIDEB siRNA was present, with Tukey's multiple comparisons tests with Sidak correction used to determine the pairwise effects of 1) 0 μM vs 400 μM oleic acid in the presence of control siRNA; 2) 0 μM vs 400 μM oleic acid in the presence of CIDEB siRNA; 3) control vs CIDEB siRNA in the presence of 0 μM oleic acid; 4) control vs CIDEB siRNA in the presence of 400 μM oleic acid. Welch's t-test was used to compare effects of control siRNA vs CIDEB siRNA on CIDEB expression via western blot and Taqman analysis since no oleic acid treatment was present. Statistical testing was performed using Prism 9.

Example 2: Loss-of-Function in CIDEB is Associated with Lower Liver Transaminases and Protection Against Liver Disease To identify genetic factors contributing to predisposition for or protection against chronic liver disease, an exome-sequencing analysis of alanine aminotransferase (ALT), a widely used biomarker of liver damage, was performed in over 500,000 people from the UK Biobank (UKB) cohort and the MyCode Community Health Initiative from Geisinger Health System (GHS). The UKB is a population-based cohort including individuals 40-69 years of age recruited at 22 testing sites in the UK between 2006-2010 (PLoS Med 2015; 12:e1001779). 411,926 European ancestry, 9,830 South Asian ancestry, 8,544 African ancestry, 2,108 East Asian ancestry and 587 American ancestry participants with available whole-exome sequencing and transaminase data were included (Table 19). MyCode is a health system-based cohort of patients from rural Pennsylvania (USA) recruited in 2007-2021 (Genet Med 2016; 18:906-13). 109,909 European ancestry participants with available whole-exome sequencing and transaminase data were included (Table 19).

TABLE 19

Baseline characteristics of individuals included in exome-wide association analyses

| Variable | UKB study (N = 432,995) | GHS study (N = 109,909) |
|---|---|---|
| Age, mean (SD) in years | 57 (8) | 59 (17) |
| Women, N (%) | 234,632 (54) | 66,739 (61) |
| Participant ancestry (%) | | |
| European | 411,926 (95.1) | 109,909 (100) |
| African | 8,544 (2) | |
| East Asian | 2,108 (0.5) | |
| South Asian | 9,830 (2.3) | |
| Admixed American | 587 (0.1) | |
| Body mass index, mean (SD) in kg/m$^2$ | 27.4 (4.8) | 31.3 (7.3) |
| Alanine Aminotransferase mean (SD) U/L | 23.5 (14.1) | 24.8 (11.6) |
| Aspartate Aminotransferase mean (SD) U/L | 26.2 (10.2) | 23.7 (6.4) |
| Body weight, mean (SD) in kg | 78 (16) | 89 (24) |
| Body mass index WHO categories, N (%) | | |
| Underweight (<18.5 kg/m$^2$) | 2,111 (0.5) | 813 (0.7) |
| Healthy weight (18.5 to <25 kg/m$^2$) | 140,560 (32.5) | 20,097 (18.3) |
| Overweight (25 to <30 kg/m$^2$) | 183,668 (42.4) | 31,725 (28.9) |
| Obesity, non-severe (30 to <40 kg/m$^2$) | 96,834 (22.4) | 41,918 (38.1) |
| Severe obesity (40 kg/m$^2$) | 8,105 (1.9) | 13,377 (12.2) |
| Blood pressure, mean (SD) in mmHg | | |
| Systolic | 137 (16) | 125 (10) |
| Diastolic | 82 (8) | 74 (6) |
| Low-density lipoprotein cholesterol, mean (SD) in mg/dL | 137 (34) | 106 (29) |
| Triglycerides, median (IQR) in mg/dL | 131 (98) | 125 (82) |

Abbreviations:
UKB, UK Biobank;
GHS, Geisinger Health System;
SD, standard deviation;
N, number of participants;
WHO, World Health Organization;
kg/m$^2$, kilograms per square meter;
mg/dL, milligrams per deciliter;
mmHg, millimeters of mercury;
IQR, inter-quartile range.

For each gene in the genome, associations with ALT were estimated for the burden of rare predicted loss-of-function (pLOF) and missense variants identified by exome sequencing (see Methods in Example 1). Statistically significant findings for a novel association in the CIDEB gene were subsequently evaluated for their association with: 1) aspartate aminotransferase (AST), another transaminase often associated with liver damage, 2) liver disease clinical outcomes, and 3) liver histopathology (see Methods in Example 1).

In the exome-wide analysis, the burden of rare (alternative allele frequency (AAF)<1%) predicted loss-of-function (pLOF) or missense genetic variants in the CIDEB gene was strongly associated with lower ALT at the exome-wide level of statistical significance (p<3.6×10$^{-7}$, a Bonferroni correction for 20,000 genes and seven variant selection models, Table 20), a novel association. Rare pLOF or missense variants in CIDEB were also associated with lower AST levels (Table 20).

TABLE 20

Associations with lower transaminase levels for the burden of rare pLOF plus missense variants in the CIDEB gene (gene = CIDEB; genetic exposure = pLOF plus any missense, AAF <1%)

| Outcome | Beta (95% CI), per allele | p | AAF, fraction of 1 | Genotype counts, RR\|RA\|AA genotypes |
|---|---|---|---|---|
| ALT | −0.09 (−0.12, −0.06) SD, −1.24 (−1.66, −0.83) U/L | 4.8 × 10$^{-09}$ | 0.00333 | 539,292\|3,609\|3 |

TABLE 20-continued

Associations with lower transaminase levels for the burden of rare pLOF plus missense variants in the CIDEB gene (gene = CIDEB; genetic exposure = pLOF plus any missense, AAF <1%)

| Outcome | Beta (95% CI), per allele | p | AAF, fraction of 1 | Genotype counts, RR\|RA\|AA genotypes |
|---|---|---|---|---|
| AST | −0.10 (−0.13, −0.07) SD, −0.95 (−1.26, −0.65) U/L | $1.0 \times 10^{-09}$ | 0.00333 | 536,658\|3,589\|3 |

Abbreviations:
CI, confidence interval;
SD, standard deviation;
U/L, unit liter;
AAF, alternative allele frequency;
RR, reference-reference genotype;
RA, reference-alternative heterozygous genotype;
AA, alternative-alternative homozygous genotype;
pLOF, predicted loss of function.

An association for rare CIDEB pLOF variants alone (excluding missense variants) with lower transaminases was also observed (Table 21), indicating that the association for rare pLOF plus missense variants reflects a loss-of-function in CIDEB.

TABLE 21

Associations with lower transaminase levels for the burden of rare pLOF variants in the CIDEB gene (gene = CIDEB; genetic exposure = pLOF, AAF <1%)

| Outcome | Beta (95% CI), per allele | p | AAF, fraction of 1 | Genotype counts, RR\|RA\|AA genotypes |
|---|---|---|---|---|
| ALT | −0.12 (−0.18, −0.05) SD, −1.57 (−2.48, −0.67) U/L | $6.6 \times 10^{-04}$ | 0.0007 | 542,144\|760\|0 |
| AST | −0.12 (−0.19, −0.06) SD, −1.25 (−1.91, −0.58) U/L | $2.8 \times 10^{-04}$ | 0.0007 | 539,495\|755\|0 |

Abbreviations:
CI, confidence interval;
SD, standard deviation;
U/L, unit liter;
AAF, alternative allele frequency;
RR, reference-reference genotype;
RA, reference-alternative heterozygous genotype;
AA, alternative-alternative homozygous genotype;
pLOF, predicted loss of function.

The associations of CIDEB rare coding variants with risk of liver disease outcomes across etiologies and severity spectrum we estimated. Rare coding variants in CIDEB were associated with: 1) lower risk of any-cause, alcoholic and nonalcoholic liver disease, 2) lower risk of any-cause, alcoholic and nonalcoholic cirrhosis, and 3) lower risk of viral hepatitis. Heterozygous carriers of rare coding variants had 29-53% lower odds of these outcomes compared with non-carriers (FIG. 1). On the log-linear scale and in the same set of individuals, the protective associations for rare coding variants in CIDEB were 3- to 7-fold larger than the rs72613567 splice LOF variant in the HSD17B13 gene previously reported to be associated with protection against liver disease (N. Engl. J. Med., 2018, 378, 1096-106) (FIG. 1).

Figure 2:
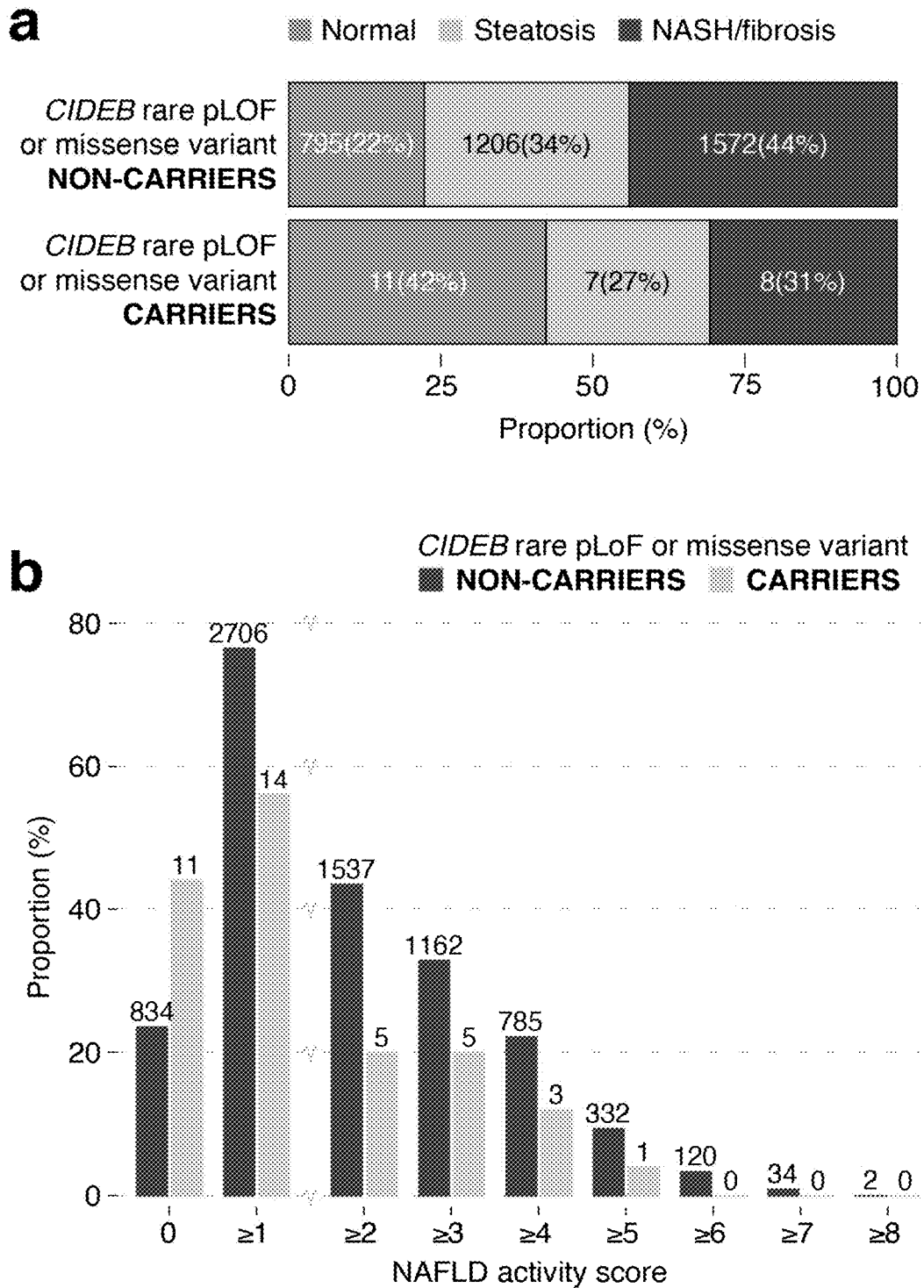
FIG. 2 shows an association of rare coding variants in CIDEB with liver histopathology phenotypes in bariatric surgery patients. Panel a shows the breakdown of liver histopathology categories (i.e., normal liver, simple steatosis, NASH or fibrosis) among carriers and non-carriers of rare coding (i.e., pLOF and missense) variants in CIDEB. Panel b shows the distribution of nonalcoholic fatty liver disease activity score at liver histopathology among carriers and non-carriers of rare coding (i.e., pLOF plus missense) variants in CIDEB. Data are from perioperative liver biopsies of participants in the GHS bariatric surgery cohort. Abbreviations: pLOF, predicted loss of function; NASH, nonalcoholic steatohepatitis; NALD, nonalcoholic fatty liver disease.

Associations with liver histopathology phenotypes in 3,599 bariatric surgery patients who underwent a perioperative liver biopsy (see Methods in Example 1) were estimated. Individuals carrying rare pLOF or missense variants in CIDEB had lower odds of biopsy-defined hepatic steatosis, NASH or fibrosis compared to non-carriers (per-allele odds ratio (OR), 0.34; 95% confidence interval, 0.14 to 0.79; p=0.012; FIG. 2, panel a). This association was driven by both a lower proportion of bariatric patients with simple steatosis and a lower proportion of patients with NASH or fibrosis among carriers (Table 22). Rare pLOF or missense variants in CIDEB were also associated with a lower NASH-CRN nonalcoholic fatty-liver disease activity score (NAS) at biopsy (per-allele beta in standard deviation units of the score, −0.56, 95% CI −0.88 to −0.24; per-allele beta in untransformed score units, −0.98; 95% CI −1.54 to −0.41; p=$7\times10^{-4}$, FIG. 2, panel b and Table 22).

TABLE 22

Association between rare pLOF or rare missense variants in CIDEB and liver histopathology phenotypes

| Outcome | OR or beta$_{SD}$ (95% CI) | P-value | CIDEB genotype counts (Ref/Het/Hom) |
|---|---|---|---|
| Steatosis/NASH/ fibrosis vs. normal liver | 0.34 (0.14 to 0.79) | 0.012 | Cases: 2778/15/0; Controls: 795/11/0 |
| Simple steatosis vs. normal liver | 0.37 (0.14 to 1.00) | 0.05 | Cases: 1206/7/0; Controls: 795/11/0 |
| NASH/fibrosis vs. normal liver | 0.25 (0.09 to 0.69) | 0.007 | Cases: 1572/8/0; Controls: 795/11/0 |

TABLE 22-continued

Association between rare pLOF or rare missense variants in CIDEB and liver histopathology phenotypes

| Outcome | OR or beta$_{SD}$ (95% CI) | P-value | CIDEB genotype counts (Ref/Het/Hom) |
|---|---|---|---|
| NAFLD activity score | −0.56 (−0.88 to −0.24) | 0.0007 | Participants: 3540/25/0 |

Abbreviations:
OR, odds ratio;
SD, standard deviation;
CI, confidence interval;
Ref, homozygous reference genotype;
Het, heterozygous carrier of rare pLOF or missense variant in CIDEB;
Hom, homozygous carrier of rare pLOF or missense variant in CIDEB;
NASH; nonalcoholic steatohepatitis;
NAFLD, nonalcoholic fatty liver disease.

Figure 3:
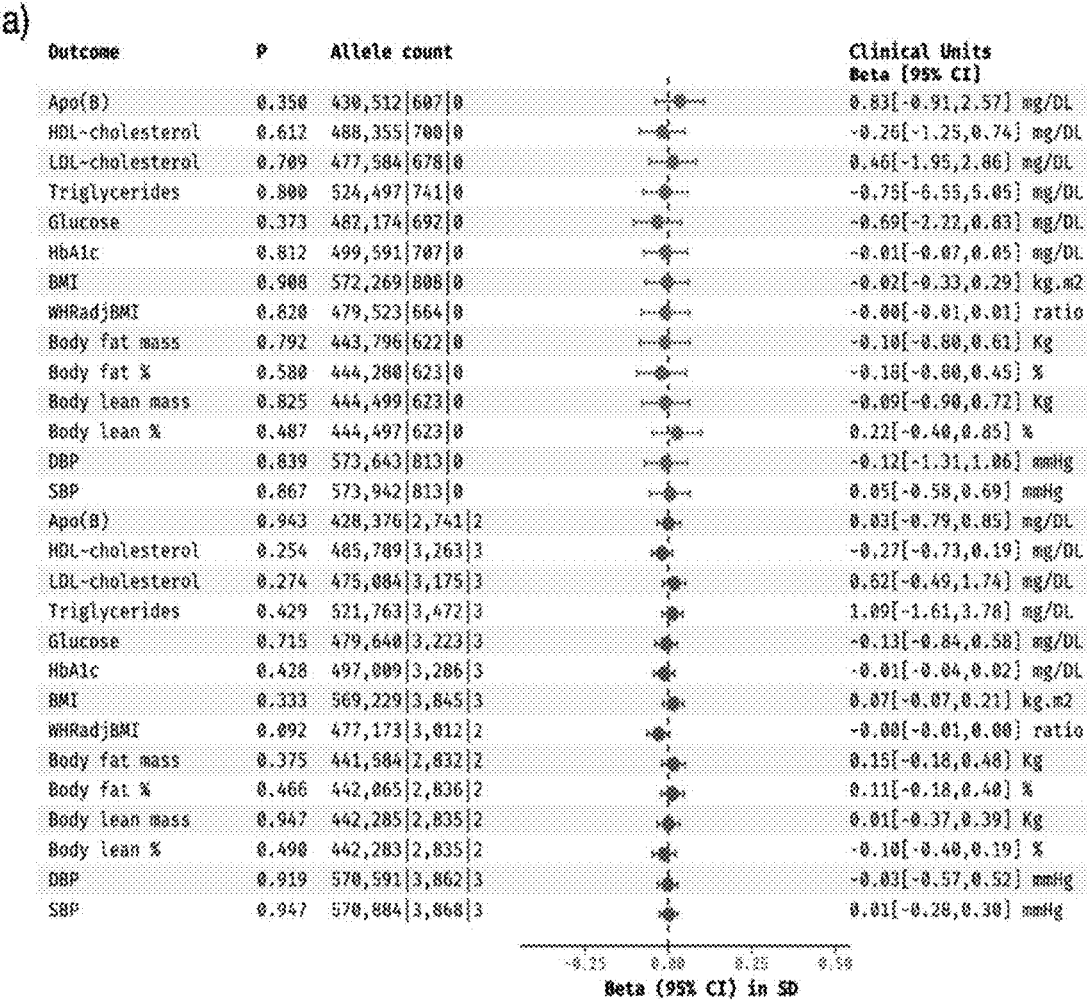
FIG. 3 shows associations with metabolic traits of rare coding variants in CIDEB. Associations estimates in blue are for rare coding (pLOF and missense) variants, while association estimates in red are for rare pLOF variants only. Panel a shows associations with continuous traits, while Panel b shows associations with binary outcomes traits. Abbreviations: HDL, high-density lipoprotein; LDL, low-density lipoprotein; BMI, Body mass index; WHRadjBMI, Waist-hip ratio adjusted for BMI; DBP, Diastolic blood pressure; SBP, Systolic blood pressure; pLOF, predicted loss of function; CI, Confidence interval; $kg/m^2$, kilograms per square meter; mg/DL, milligrams per deciliter; and mmHg, millimeter of mercury.

Associations with lipid, glycemic, and anthropometric traits for rare coding variants in CIDEB in over 500,000 people (FIG. 3) were estimated. Statistically significant associations for CIDEB pLOF or missense variants were not found with these traits, except for a nominally significant association with lower risk of type 2 diabetes (per-allele odds ratio, 0.87; 95% CI, 0.79 to 0.97; p=0.011).

Furthermore, whether rare pLOF or missense variants in CIDEB were associated with any of 6,040 clinical phenotypes was explored in a phenome-wide wide analysis in the GHS, UKB, or a meta-analysis of these two cohorts. In this analysis, no statistically significant associations were observed with clinical phenotypes other than the associations with lower liver enzymes and outcomes described above, after correction for the number of statistical tests performed ($p<8.3\times10^{-6}$).

The associations between CIDEB and liver phenotypes were driven by multiple rare pLOF or missense variants in the CIDEB gene (Table 23).

TABLE 23

Missense or pLOF variants of CIDEB that were identified by exome sequencing and included in the gene burden association analyses

| Genomic coordinates for the genetic variant, C:P:R:A | Coding DNA change | Protein change | Variant classified as pLOF | AAF, fraction of 1 |
|---|---|---|---|---|
| 14:24305640:G:A | c.653C > T, c.653C > T, c.653C > T | p.Ser218Phe, p.Ser218Phe, p.Ser218Phe | No | 4.0E−05 |
| 14:24305643:T:C | c.650A > G, c.650A > G, c.650A > G | p.His217Arg, p.His217Arg, p.His217Arg | No | 1.7E−05 |
| 14:24305649:C:T | c.644G > A, c.644G > A, c.644G > A | p.Arg215His, p.Arg215His, p.Arg215His | No | 1.2E−05 |
| 14:24305650:G:A | c.643C > T, c.643C > T, c.643C > T | p.Arg215Cys, p.Arg215Cys, p.Arg215Cys | No | 1.1E−05 |
| 14:24305650:G:C | c.643C > G, c.643C > G, c.643C > G | p.Arg215Gly, p.Arg215Gly, p.Arg215Gly | No | 3.8E−05 |
| 14:24305658:T:G | c.635A > C, c.635A > C, c.635A > C | p.Gln212Pro, p.Gln212Pro, p.Gln212Pro | No | 1.1E−05 |
| 14:24305664:C:T | c.629G > A, c.629G > A, c.629G > A | p.Trp210*, p.Trp210*, p.Trp210* | Yes | 1.1E−05 |
| 14:24305667:T:C | c.626A > G, c.626A > G, c.626A > G | p.Gln209Arg, p.Gln209Arg, p.Gln209Arg | No | 4.3E−06 |
| 14:24305671:C:T | c.622G > A, c.622G > A, c.622G > A | p.Glu208Lys, p.Glu208Lys, p.Glu208Lys | No | 5.8E−04 |
| 14:24305683:C:G | c.610G > C, c.610G > C, c.610G > C | p.Val204Leu, p.Val204Leu, p.Val204Leu | No | 5.8E−06 |
| 14:24305686:C:G | c.607G > C, c.607G > C, c.607G > C | p.Ala203Pro, p.Ala203Pro, p.Ala203Pro | No | 1.1E−04 |
| 14:24305691:C:T | c.602G > A, c.602G > A, c.602G > A | p.Arg201His, p.Arg201His, p.Arg201His | No | 2.9E−05 |
| 14:24305718:A:G | c.575T > C, c.575T > C, c.575T > C | p.Met192Thr, p.Met192Thr, p.Met192Thr | No | 1.4E−05 |
| 14:24305721:T:C | c.572A > G, c.572A > G, c.572A > G | p.His191Arg, p.His191Arg, p.His191Arg | No | 3.3E−05 |
| 14:24305733:T:C | c.560A > G, c.560A > G, c.560A > G | p.Gln187Arg, p.Gln187Arg, p.Gln187Arg | No | 2.0E−05 |
| 14:24305755:G:A | c.538C > T, c.538C > T, c.538C > T | p.Arg180Cys, p.Arg180Cys, p.Arg180Cys | No | 9.7E−05 |
| 14:24305766:C:T | c.528 − 1G > A, c.528 − 1G > A, c.528 − 1G > A | | Yes | 9.3E−06 |
| 14:24305946:C:T | c.527 + 1G > A, c.527 + 1G > A, c.527 + 1G > A | | Yes | 5.8E−05 |
| 14:24305953:A:G | c.521T > C, c.521T > C, c.521T > C | p.Val174Ala, p.Val174Ala, p.Val174Ala | No | 1.5E−05 |
| 14:24305963:G:A | c.511C > T, c.511C > T, c.511C > T | p.Pro171Ser, p.Pro171Ser, p.Pro171Ser | No | 4.5E−06 |
| 14:24305966:C:T | c.508G > A, c.508G > A, c.508G > A | p.Gly170Ser, p.Gly170Ser, p.Gly170Ser | No | 4.5E−06 |
| 14:24305972:C:G | c.502G > C, c.502G > C, c.502G > C | p.Gly168Arg, p.Gly168Arg, p.Gly168Arg | No | 7.8E−06 |
| 14:24305988:CAT:C | c.484_485delAT, c.484_485delAT, c.484_485delAT | p.Met162fs, p.Met162fs, p.Met162fs | Yes | 2.8E−05 |
| 14:24305990:T:C | c.484A > G, c.484A > G, c.484A > G | p.Met162Val, p.Met162Val, p.Met162Val | No | 5.8E−06 |
| 14:24306002:C:T | c.472G > A, c.472G > A, c.472G > A | p.Gly158Arg, p.Gly158Arg, p.Gly158Arg | No | 1.7E−05 |
| 14:24306017:T:A | c.457A > T, c.457A > T, c.457A > T | p.Lys153*, p.Lys153*, p.Lys153* | Yes | 5.5E−05 |
| 14:24306041:C:G | c.433G > C, c.433G > C, c.433G > C | p.Asp145His, p.Asp145His, p.Asp145His | No | 4.3E−06 |
| 14:24306047:G:A | c.427C > T, c.427C > T, c.427C > T | p.Pro143Ser, p.Pro143Ser, p.Pro143Ser | No | 4.7E−05 |
| 14:24306052:TG:T | c.421delC, c.421delC, c.421delC | p.Gln141fs, p.Gln141fs, p.Gln141fs | Yes | 2.3E−05 |
| 14:24306062:C:A | c.412G > T, c.412G > T, c.412G > T | p.Val138Leu, p.Val138Leu, p.Val138Leu | No | 3.5E−06 |
| 14:24306062:C:T | c.412G > A, c.412G > A, c.412G > A | p.Val138Met, p.Val138Met, p.Val138Met | No | 4.9E−05 |
| 14:24306076:C:T | c.398G > A, c.398G > A, c.398G > A | p.Arg133Gln, p.Arg133Gln, p.Arg133Gln | No | 1.7E−05 |
| 14:24306077:G:A | c.397C > T, c.397C > T, c.397C > T | p.Arg133*, p.Arg133*, p.Arg133* | Yes | 2.7E−05 |
| 14:24306082:A:G | c.392T > C, c.392T > C, c.392T > C | p.Ile131Thr, p.Ile131Thr, p.Ile131Thr | No | 8.9E−06 |
| 14:24306095:G:A | c.379C > T, c.379C > T, c.379C > T | p.His127Tyr, p.His127Tyr, p.His127Tyr | No | 7.2E−06 |
| 14:24306109:C:T | c.365G > A, c.365G > A, c.365G > A | p.Arg122Gln, p.Arg122Gln, p.Arg122Gln | No | 7.5E−05 |
| 14:24306110:G:A | c.364C > T, c.364C > T, c.364C > T | p.Arg122Trp, p.Arg122Trp, p.Arg122Trp | No | 4.0E−04 |
| 14:24306131:C:T | c.343G > A, c.343G > A, c.343G > A | p.Val115Met, p.Val115Met, p.Val115Met | No | 2.1E−05 |
| 14:24306373:C:T | c.336 + 1G > A, c.336 + 1G > A, c.336 + 1G > A | | Yes | 4.1E−04 |

TABLE 23-continued

Missense or pLOF variants of CIDEB that were identified by exome sequencing and included in the gene burden association analyses

| Genomic coordinates for the genetic variant, C:P:R:A | Coding DNA change | Protein change | Variant classified as pLOF | AAF, fraction of 1 |
|---|---|---|---|---|
| 14:24306379:T:C | c.331A > G, c.331A > G, c.331A > G | p.Thr111Ala, p.Thr111Ala, p.Thr111Ala | No | 3.6E-05 |
| 14:24306383:G:C | c.327C > G, c.327C > G, c.327C > G | p.Ser109Arg, p.Ser109Arg, p.Ser109Arg | No | 1.3E-05 |
| 14:24306403:G:A | c.307C > T, c.307C > T, c.307C > T | p.Gln103*, p.Gln103*, p.Gln103* | Yes | 1.4E-05 |
| 14:24306410:C:T | c.300G > A, c.300G > A, c.300G > A | p.Met100Ile, p.Met100Ile, p.Met100Ile | No | 3.2E-05 |
| 14:24306417:C:T | c.293G > A, c.293G > A, c.293G > A | p.Cys98Tyr, p.Cys98Tyr, p.Cys98Tyr | No | 1.8E-05 |
| 14:24306420:G:C | c.290C > G, c.290C > G, c.290C > G | p.Thr97Arg, p.Thr97Arg, p.Thr97Arg | No | 1.1E-05 |
| 14:24306420:G:A | c.290C > T, c.290C > T, c.290C > T | p.Thr97Met, p.Thr97Met, p.Thr97Met | No | 6.4E-04 |
| 14:24306423:T:G | c.287A > C, c.287A > C, c.287A > C | p.Asp96Ala, p.Asp96Ala, p.Asp96Ala | No | 5.2E-05 |
| 14:24306437:C:G | c.273G > C, c.273G > C, c.273G > C | p.Gln91His, p.Gln91His, p.Gln91His | No | 5.2E-06 |
| 14:24306442:A:G | c.268T > C, c.268T > C, c.268T > C | p.Phe90Leu, p.Phe90Leu, p.Phe90Leu | No | 4.7E-06 |
| 14:24306451:C:T | c.259G > A, c.259G > A, c.259G > A | p.Glu87Lys, p.Glu87Lys, p.Glu87Lys | No | 5.6E-05 |
| 14:24306463:C:T | c.247G > A, c.247G > A, c.247G > A | p.Ala83Thr, p.Ala83Thr, p.Ala83Thr | No | 1.2E-04 |
| 14:24306483:A:G | c.227T > C, c.227T > C, c.227T > C | p.Val76Ala, p.Val76Ala, p.Val76Ala | No | 2.2E-05 |
| 14:24306486:A:C | c.224T > G, c.224T > G, c.224T > G | p.Leu75Arg, p.Leu75Arg, p.Leu75Arg | No | 1.5E-05 |
| 14:24306504:A:G | c.206T > C, c.206T > C, c.206T > C | p.Leu69Pro, p.Leu69Pro, p.Leu69Pro | No | 5.3E-06 |
| 14:24307385:C:T | c.172G > A, c.172G > A, c.172G > A | p.Glu58Lys, p.Glu58Lys, p.Glu58Lys | No | 3.1E-05 |
| 14:24307390:C:T | c.167G > A, c.167G > A, c.167G > A | p.Arg56His, p.Arg56His, p.Arg56His | No | 1.0E-05 |
| 14:24307411:T:C | c.146A > G, c.146A > G, c.146A > G | p.Lys49Arg, p.Lys49Arg, p.Lys49Arg | No | 2.8E-05 |
| 14:24307423:C:T | c.134G > A, c.134G > A, c.134G > A | p.Arg45Gln, p.Arg45Gln, p.Arg45Gln | No | 1.1E-05 |
| 14:24307424:G:A | c.133C > T, c.133C > T, c.133C > T | p.Arg45Trp, p.Arg45Trp, p.Arg45Trp | No | 6.1E-05 |
| 14:24307442:G:A | c.115C > T, c.115C > T, c.115C > T | p.Arg39Cys, p.Arg39Cys, p.Arg39Cys | No | 1.0E-04 |
| 14:24307447:G:A | c.110C > T, c.110C > T, c.110C > T | p.Pro37Leu, p.Pro37Leu, p.Pro37Leu | No | 8.3E-06 |
| 14:24307451:G:A | c.106C > T, c.106C > T, c.106C > T | p.Arg36*, p.Arg36*, p.Arg36* | Yes | 3.4E-05 |
| 14:24307461:TG:T | c.95delC, c.95delC, c.95delC | p.Pro32fs, p.Pro32fs, p.Pro32fs | Yes | 1.3E-05 |
| 14:24307469:AG:A | c.87delC, c.87delC, c.87delC | p.Ser30fs, p.Ser30fs, p.Ser30fs | Yes | 1.7E-05 |
| 14:24307474:T:A | c.83G > A, c.83G > A, c.83G > A | p.Trp28*, p.Trp28*, p.Trp28* | Yes | 5.3E-06 |
| 14:24307483:C:T | c.74G > A, c.74G > A, c.74G > A | p.Arg25Gln, p.Arg25Gln, p.Arg25Gln | No | 3.4E-05 |
| 14:24307484:G:A | c.73C > T, c.73C > T, c.73C > T | p.Arg25Trp, p.Arg25Trp, p.Arg25Trp | No | 2.9E-05 |
| 14:24307495:G:A | c.62C > T, c.62C > T, c.62C > T | p.Ser21Leu, p.Ser21Leu, p.Ser21Leu | No | 1.3E-05 |
| 14:24307498:C:T | c.59G > A, c.59G > A, c.59G > A | p.Ser20Asn, p.Ser20Asn, p.Ser20Asn | No | 7.6E-05 |
| 14:24307825:A:C | c.34T > G, c.34T > G, c.34T > G | p.Leu12Val, p.Leu12Val, p.Leu12Val | No | 7.1E-05 |
| 14:24307829:A:C | c.30T > G, c.30T > G, c.30T > G | p.Ser10Arg, p.Ser10Arg, p.Ser10Arg | No | 4.7E-06 |
| 14:24307839:A:C | c.20T > G, c.20T > G, c.20T > G | p.Leu7Arg, p.Leu7Arg, p.Leu7Arg | No | 7.6E-06 |
| 14:24305635:A:AGTAG | c.654_657dupCTAC, c.654_657dupCTAC, c.654_657dupCTAC | p.Ter220fs, p.Ter220fs, p.Ter220fs | Yes | 3.2E-06 |
| 14:24305641:A:C | c.652T > G, c.652T > G, c.652T > G | p.Ser218Ala, p.Ser218Ala, p.Ser218Ala | No | 1.2E-05 |
| 14:24305662:G:T | c.631C > A, c.631C > A, c.631C > A | p.Gln211Lys, p.Gln211Lys, p.Gln211Lys | No | 3.9E-06 |
| 14:24305677:C:G | c.616G > C, c.616G > C, c.616G > C | p.Gly206Arg, p.Gly206Arg, p.Gly206Arg | No | 6.7E-06 |
| 14:24305692:G:A | c.601C > T, c.601C > T, c.601C > T | p.Arg201Cys, p.Arg201Cys, p.Arg201Cys | No | 6.0E-06 |
| 14:24305701:A:T | c.592T > A, c.592T > A, c.592T > A | p.Ser198Thr, p.Ser198Thr, p.Ser198Thr | No | 3.2E-06 |
| 14:24305728:G:GGCCTT | c.560_564dupAAGGC, c.560_564dupAAGGC, c.560_564dupAAGGC | p.Leu189fs, p.Leu189fs, p.Leu189fs | Yes | 3.7E-06 |
| 14:24305743:T:C | c.550A > G, c.550A > G, c.550A > G | p.Thr184Ala, p.Thr184Ala, p.Thr184Ala | No | 3.2E-06 |
| 14:24305754:C:T | c.539G > A, c.539G > A, c.539G > A | p.Arg180His, p.Arg180His, p.Arg180His | No | 8.6E-06 |
| 14:24305948:T:C | c.526A > G, c.526A > G, c.526A > G | p.Arg176Gly, p.Arg176Gly, p.Arg176Gly | No | 3.2E-06 |
| 14:24305953:ACTTT:A | c.517_520delAAAG, c.517_520delAAAG, c.517_520delAAAG | p.Lys173fs, p.Lys173fs, p.Lys173fs | Yes | 1.5E-05 |
| 14:24306014:C:T | c.460G > A, c.460G > A, c.460G > A | p.Ala154Thr, p.Ala154Thr, p.Ala154Thr | No | 3.4E-06 |
| 14:24306044:G:A | c.430C > T, c.430C > T, c.430C > T | p.Arg144*, p.Arg144*, p.Arg144* | Yes | 2.3E-05 |
| 14:24306064:T:C | c.410A > G, c.410A > G, c.410A > G | p.Asp137Gly, p.Asp137Gly, p.Asp137Gly | No | 3.2E-06 |
| 14:24306080:C:T | c.394G > A, c.394G > A, c.394G > A | p.Ala132Thr, p.Ala132Thr, p.Ala132Thr | No | 4.3E-05 |
| 14:24306083:T:A | c.391A > T, c.391A > T, c.391A > T | p.Ile131Phe, p.Ile131Phe, p.Ile131Phe | No | 3.2E-06 |
| 14:24306087:C:G | c.387G > C, c.387G > C, c.387G > C | p.Lys129Asn, p.Lys129Asn, p.Lys129Asn | No | 4.5E-06 |
| 14:24306095:G:T | c.379C > A, c.379C > A, c.379C > A | p.His127Asn, p.His127Asn, p.His127Asn | No | 1.5E-05 |
| 14:24306134:C:G | c.340G > C, c.340G > C, c.340G > C | p.Gly114Arg, p.Gly114Arg, p.Gly114Arg | No | 3.4E-06 |
| 14:24306138:CTG:C | c.337 − 3_337 − 2delCA, c.337 − 3_337 − 2delCA, c.337 − 3_337 − 2delCA | | Yes | 8.0E-06 |
| 14:24306139:T:C | c.337 − 2A > G, c.337 − 2A > G, c.337 − 2A > G | | Yes | 2.1E-05 |
| 14:24306373:C:A | c.336 + 1G > T, c.336 + 1G > T, c.336 + 1G > T | | Yes | 1.3E-05 |
| 14:24306382:G:A | c.328C > T, c.328C > T, c.328C > T | p.Pro110Ser, p.Pro110Ser, p.Pro110Ser | No | 3.2E-06 |
| 14:24306387:C:T | c.323G > A, c.323G > A, c.323G > A | p.Trp108*, p.Trp108*, p.Trp108* | Yes | 4.5E-06 |
| 14:24306418:A:G | c.292T > C, c.292T > C, c.292T > C | p.Cys98Arg, p.Cys98Arg, p.Cys98Arg | No | 8.4E-06 |
| 14:24306433:G:GA | c.276_277insT, c.276_277insT, c.276_277insT | p.Leu93fs, p.Leu93fs, p.Leu93fs | Yes | 5.4E-06 |

TABLE 23-continued

Missense or pLOF variants of CIDEB that were identified by exome sequencing and included in the gene burden association analyses

| Genomic coordinates for the genetic variant, C:P:R:A | Coding DNA change | Protein change | Variant classified as pLOF | AAF, fraction of 1 |
|---|---|---|---|---|
| 14:24306439:G:C | c.271C > G, c.271C > G, c.271C > G | p.Gln91Glu, p.Gln91Glu, p.Gln91Glu | No | 3.2E−06 |
| 14:24306444:A:G | c.266T > C, c.266T > C, c.266T > C | p.Phe89Ser, p.Phe89Ser, p.Phe89Ser | No | 3.2E−06 |
| 14:24306469:C:T | c.241G > A, c.241G > A, c.241G > A | p.Gly81Arg, p.Gly81Arg, p.Gly81Arg | No | 3.7E−06 |
| 14:24306480:A:G | c.230T > C, c.230T > C, c.230T > C | p.Leu77Pro, p.Leu77Pro, p.Leu77Pro | No | 3.2E−06 |
| 14:24306508:G:C | c.202C > G, c.202C > G, c.202C > G | p.Leu68Val, p.Leu68Val, p.Leu68Val | No | 5.6E−06 |
| 14:24306511:G:T | c.199C > A, c.199C > A, c.199C > A | p.Leu67Ile, p.Leu67Ile, p.Leu67Ile | No | 3.2E−06 |
| 14:24307382:G:C | c.175C > G, c.175C > G, c.175C > G | p.Leu59Val, p.Leu59Val, p.Leu59Val | No | 3.2E−06 |
| 14:24307391:G:A | c.166C > T, c.166C > T, c.166C > T | p.Arg56Cys, p.Arg56Cys, p.Arg56Cys | No | 5.2E−06 |
| 14:24307402:G:A | c.155C > T, c.155C > T, c.155C > T | p.Thr52Ile, p.Thr52Ile, p.Thr52Ile | No | 1.4E−05 |
| 14:24307405:A:G | c.152T > C, c.152T > C, c.152T > C | p.Leu51Pro, p.Leu51Pro, p.Leu51Pro | No | 6.2E−06 |
| 14:24307421:T:A | c.136A > T, c.136A > T, c.136A > T | p.Thr46Ser, p.Thr46Ser, p.Thr46Ser | No | 3.2E−06 |
| 14:24307441:C:A | c.116G > T, c.116G > T, c.116G > T | p.Arg39Leu, p.Arg39Leu, p.Arg39Leu | No | 3.2E−06 |
| 14:24307441:C:T | c.116G > A, c.116G > A, c.116G > A | p.Arg39His, p.Arg39His, p.Arg39His | No | 3.9E−05 |
| 14:24307448:G:T | c.109C > A, c.109C > A, c.109C > A | p.Pro37Thr, p.Pro37Thr, p.Pro37Thr | No | 3.3E−05 |
| 14:24307450:C:T | c.107G > A, c.107G > A, c.107G > A | p.Arg36Gln, p.Arg36Gln, p.Arg36Gln | No | 1.9E−05 |
| 14:24307475:A:G | c.82T > C, c.82T > C, c.82T > C | p.Trp28Arg, p.Trp28Arg, p.Trp28Arg | No | 6.4E−06 |
| 14:24307510:A:T | c.47T > A, c.47T > A, c.47T > A | p.Val16Glu, p.Val16Glu, p.Val16Glu | No | 4.1E−06 |
| 14:24307516:C:G | c.42 − 1G > C, c.42 − 1G > C, c.42 − 1G > C |  | Yes | 1.2E−05 |
| 14:24307822:G:GT | c.36dupA, c.36dupA, c.36dupA | p.Leu13fs, p.Leu13fs, p.Leu13fs | Yes | 4.1E−06 |
| 14:24307824:A:T | c.35T > A, c.35T > A, c.35T > A | p.Leu12*, p.Leu12*, p.Leu12* | Yes | 3.9E−06 |
| 14:24307833:G:C | c.26C > G, c.26C > G, c.26C > G | p.Pro9Arg, p.Pro9Arg, p.Pro9Arg | No | 3.2E−06 |
| 14:24307851:T:TAC | c.6_7dupGT, c.6_7dupGT, c.6_7dupGT | p.Tyr3fs, p.Tyr3fs, p.Tyr3fs | Yes | 7.5E−06 |
| 14:24307857:A:C | c.2T > G, c.2T > G, c.2T > G | p.Met1?, p.Met1?, p.Met1? | Yes | 2.0E−05 |
| 14:24305635:A:C | c.658T > G, c.658T > G, c.658T > G | p.Ter220Gluext*?, p.Ter220Gluext*?, p.Ter220Gluext*? | Yes | 8.7E−07 |
| 14:24305637:T:C | c.656A > G, c.656A > G, c.656A > G | p.Tyr219Cys, p.Tyr219Cys, p.Tyr219Cys | No | 6.1E−06 |
| 14:24305638:A:G | c.655T > C, c.655T > C, c.655T > C | p.Tyr219His, p.Tyr219His, p.Tyr219His | No | 8.7E−07 |
| 14:24305652:C:T | c.641G > A, c.641G > A, c.641G > A | p.Gly214Asp, p.Gly214Asp, p.Gly214Asp | No | 4.3E−07 |
| 14:24305653:C:T | c.640G > A, c.640G > A, c.640G > A | p.Gly214Ser, p.Gly214Ser, p.Gly214Ser | No | 1.3E−06 |
| 14:24305657:C:A | c.636G > T, c.636G > T, c.636G > T | p.Gln212His, p.Gln212His, p.Gln212His | No | 4.3E−07 |
| 14:24305657:C:G | c.636G > C, c.636G > C, c.636G > C | p.Gln212His, p.Gln212His, p.Gln212His | No | 8.7E−07 |
| 14:24305660:C:G | c.633G > C, c.633G > C, c.633G > C | p.Gln211His, p.Gln211His, p.Gln211His | No | 4.3E−07 |
| 14:24305661:T:G | c.632A > C, c.632A > C, c.632A > C | p.Gln211Pro, p.Gln211Pro, p.Gln211Pro | No | 4.3E−07 |
| 14:24305661:T:C | c.632A > G, c.632A > G, c.632A > G | p.Gln211Arg, p.Gln211Arg, p.Gln211Arg | No | 4.3E−07 |
| 14:24305663:C:G | c.630G > C, c.630G > C, c.630G > C | p.Trp210Cys, p.Trp210Cys, p.Trp210Cys | No | 1.7E−06 |
| 14:24305663:C:T | c.630G > A, c.630G > A, c.630G > A | p.Trp210*, p.Trp210*, p.Trp210* | Yes | 8.7E−07 |
| 14:24305668:G:A | c.625C > T, c.625C > T, c.625C > T | p.Gln209*, p.Gln209*, p.Gln209* | Yes | 4.3E−07 |
| 14:24305671:C:A | c.622G > T, c.622G > T, c.622G > T | p.Glu208*, p.Glu208*, p.Glu208* | Yes | 4.3E−07 |
| 14:24305671:C:G | c.622G > C, c.622G > C, c.622G > C | p.Glu208Gln, p.Glu208Gln, p.Glu208Gln | No | 4.3E−07 |
| 14:24305673:G:A | c.620C > T, c.620C > T, c.620C > T | p.Ala207Val, p.Ala207Val, p.Ala207Val | No | 1.7E−06 |
| 14:24305674:C:T | c.619G > A, c.619G > A, c.619G > A | p.Ala207Thr, p.Ala207Thr, p.Ala207Thr | No | 4.3E−07 |
| 14:24305676:C:T | c.617G > A, c.617G > A, c.617G > A | p.Gly206Glu, p.Gly206Glu, p.Gly206Glu | No | 4.3E−07 |
| 14:24305678:C:G | c.615G > C, c.615G > C, c.615G > C | p.Glu205Asp, p.Glu205Asp, p.Glu205Asp | No | 4.3E−07 |
| 14:24305678:C:A | c.615G > T, c.615G > T, c.615G > T | p.Glu205Asp, p.Glu205Asp, p.Glu205Asp | No | 4.3E−07 |
| 14:24305679:T:C | c.614A > G, c.614A > G, c.614A > G | p.Glu205Gly, p.Glu205Gly, p.Glu205Gly | No | 4.3E−07 |
| 14:24305680:C:G | c.613G > C, c.613G > C, c.613G > C | p.Glu205Gln, p.Glu205Gln, p.Glu205Gln | No | 4.3E−07 |
| 14:24305682:A:C | c.611T > G, c.611T > G, c.611T > G | p.Val204Gly, p.Val204Gly, p.Val204Gly | No | 8.7E−07 |
| 14:24305685:G:T | c.608C > A, c.608C > A, c.608C > A | p.Ala203Glu, p.Ala203Glu, p.Ala203Glu | No | 4.3E−07 |
| 14:24305685:G:C | c.608C > G, c.608C > G, c.608C > G | p.Ala203Gly, p.Ala203Gly, p.Ala203Gly | No | 2.6E−06 |
| 14:24305688:T:G | c.605A > C, c.605A > C, c.605A > C | p.His202Pro, p.His202Pro, p.His202Pro | No | 4.3E−07 |
| 14:24305695:G:C | c.598C > G, c.598C > G, c.598C > G | p.Leu200Val, p.Leu200Val, p.Leu200Val | No | 4.3E−07 |
| 14:24305695:G:T | c.598C > A, c.598C > A, c.598C > A | p.Leu200Ile, p.Leu200Ile, p.Leu200Ile | No | 1.3E−06 |
| 14:24305697:G:C | c.596C > G, c.596C > G, c.596C > G | p.Thr199Ser, p.Thr199Ser, p.Thr199Ser | No | 4.3E−07 |
| 14:24305706:A:G | c.587T > C, c.587T > C, c.587T > C | p.Ile196Thr, p.Ile196Thr, p.Ile196Thr | No | 4.3E−07 |
| 14:24305709:C:T | c.584G > A, c.584G > A, c.584G > A | p.Gly195Glu, p.Gly195Glu, p.Gly195Glu | No | 4.3E−07 |
| 14:24305710:C:T | c.583G > A, c.583G > A, c.583G > A | p.Gly195Arg, p.Gly195Arg, p.Gly195Arg | No | 1.7E−06 |
| 14:24305721:T:A | c.572A > T, c.572A > T, c.572A > T | p.His191Leu, p.His191Leu, p.His191Leu | No | 8.7E−07 |
| 14:24305722:G:C | c.571C > G, c.571C > G, c.571C > G | p.His191Asp, p.His191Asp, p.His191Asp | No | 4.3E−07 |
| 14:24305727:A:C | c.566T > G, c.566T > G, c.566T > G | p.Leu189Arg, p.Leu189Arg, p.Leu189Arg | No | 4.3E−07 |
| 14:24305730:C:A | c.563G > T, c.563G > T, c.563G > T | p.Gly188Val, p.Gly188Val, p.Gly188Val | No | 4.3E−07 |
| 14:24305748:G:T | c.545C > A, c.545C > A, c.545C > A | p.Thr182Asn, p.Thr182Asn, p.Thr182Asn | No | 4.3E−07 |
| 14:24305748:G:C | c.545C > G, c.545C > G, c.545C > G | p.Thr182Ser, p.Thr182Ser, p.Thr182Ser | No | 4.3E−07 |
| 14:24305749:T:C | c.544A > G, c.544A > G, c.544A > G | p.Thr182Ala, p.Thr182Ala, p.Thr182Ala | No | 4.3E−07 |
| 14:24305752:A:G | c.541T > C, c.541T > C, c.541T > C | p.Trp181Arg, p.Trp181Arg, p.Trp181Arg | No | 4.3E−07 |
| 14:24305754:C:A | c.539G > T, c.539G > T, c.539G > T | p.Arg180Leu, p.Arg180Leu, p.Arg180Leu | No | 8.7E−07 |
| 14:24305758:G:C | c.535C > G, c.535C > G, c.535C > G | p.Leu179Val, p.Leu179Val, p.Leu179Val | No | 4.3E−07 |
| 14:24305761:G:A | c.532C > T, c.532C > T, c.532C > T | p.Leu178Phe, p.Leu178Phe, p.Leu178Phe | No | 4.3E−07 |
| 14:24305763:T:G | c.530A > C, c.530A > C, c.530A > C | p.Glu177Ala, p.Glu177Ala, p.Glu177Ala | No | 4.3E−07 |

TABLE 23-continued

Missense or pLOF variants of CIDEB that were identified by exome sequencing and included in the gene burden association analyses

| Genomic coordinates for the genetic variant, C:P:R:A | Coding DNA change | Protein change | Variant classified as pLOF | AAF, fraction of 1 |
|---|---|---|---|---|
| 14:24305766:C:A | c.528 − 1G > T, c.528 − 1G > T, c.528 − 1G > T | | Yes | 4.3E−07 |
| 14:24305766:C:G | c.528 − 1G > C, c.528 − 1G > C, c.528 − 1G > C | | Yes | 7.8E−06 |
| 14:24305767:T:G | c.528 − 2A > C, c.528 − 2A > C, c.528 − 2A > C | | Yes | 4.3E−07 |
| 14:24305946:C:A | c.527 + 1G > T, c.527 + 1G > T, c.527 + 1G > T | | Yes | 7.4E−06 |
| 14:24305950:A:C | c.524T > G, c.524T > G, c.524T > G | p.Leu175Arg, p.Leu175Arg, p.Leu175Arg | No | 8.7E−07 |
| 14:24305951:G:A | c.523C > T, c.523C > T, c.523C > T | p.Leu175Phe, p.Leu175Phe, p.Leu175Phe | No | 4.3E−07 |
| 14:24305953:AC:A | c.520delG, c.520delG, c.520delG | p.Val174fs, p.Val174fs, p.Val174fs | Yes | 8.7E−07 |
| 14:24305954:C:CT | c.519dupA, c.519dupA, c.519dupA | p.Val174fs, p.Val174fs, p.Val174fs | Yes | 4.3E−07 |
| 14:24305957:T:A | c.517A > T, c.517A > T, c.517A > T | p.Lys173*, p.Lys173*, p.Lys173* | Yes | 4.3E−07 |
| 14:24305958:C:A | c.516G > T, c.516G > T, c.516G > T | p.Lys172Asn, p.Lys172Asn, p.Lys172Asn | No | 4.3E−07 |
| 14:24305958:C:G | c.516G > C, c.516G > C, c.516G > C | p.Lys172Asn, p.Lys172Asn, p.Lys172Asn | No | 4.3E−07 |
| 14:24305961:TG:T | c.512delC, c.512delC, c.512delC | p.Pro171fs, p.Pro171fs, p.Pro171fs | Yes | 4.3E−07 |
| 14:24305963:G:T | c.511C > A, c.511C > A, c.511C > A | p.Pro171Thr, p.Pro171Thr, p.Pro171Thr | No | 4.3E−07 |
| 14:24305965:C:T | c.509G > A, c.509G > A, c.509G > A | p.Gly170Asp, p.Gly170Asp, p.Gly170Asp | No | 1.7E−06 |
| 14:24305966:C:A | c.508G > T, c.508G > T, c.508G > T | p.Gly170Cys, p.Gly170Cys, p.Gly170Cys | No | 4.3E−07 |
| 14:24305968:A:C | c.506T > G, c.506T > G, c.506T > G | p.Leu169Arg, p.Leu169Arg, p.Leu169Arg | No | 1.4E−05 |
| 14:24305968:A:T | c.506T > A, c.506T > A, c.506T > A | p.Leu169His, p.Leu169His, p.Leu169His | No | 4.3E−07 |
| 14:24305968:A:G | c.506T > C, c.506T > C, c.506T > C | p.Leu169Pro, p.Leu169Pro, p.Leu169Pro | No | 4.3E−07 |
| 14:24305971:C:G | c.503G > C, c.503G > C, c.503G > C | p.Gly168Ala, p.Gly168Ala, p.Gly168Ala | No | 4.3E−07 |
| 14:24305974:T:TG | c.499dupC, c.499dupC, c.499dupC | p.Gln167fs, p.Gln167fs, p.Gln167fs | Yes | 6.5E−06 |
| 14:24305974:T:C | c.500A > G, c.500A > G, c.500A > G | p.Gln167Arg, p.Gln167Arg, p.Gln167Arg | No | 8.7E−07 |
| 14:24305980:T:A | c.494A > T, c.494A > T, c.494A > T | p.Asp165Val, p.Asp165Val, p.Asp165Val | No | 4.3E−07 |
| 14:24305980:TCA:T | c.492_493delTG, c.492_493delTG, c.492_493delTG | p.Cys164fs, p.Cys164fs, p.Cys164fs | Yes | 1.3E−06 |
| 14:24305982:A:C | c.492T > G, c.492T > G, c.492T > G | p.Cys164Trp, p.Cys164Trp, p.Cys164Trp | No | 1.3E−06 |
| 14:24305986:C:G | c.488G > C, c.488G > C, c.488G > C | p.Ser163Thr, p.Ser163Thr, p.Ser163Thr | No | 4.3E−07 |
| 14:24305986:C:T | c.488G > A, c.488G > A, c.488G > A | p.Ser163Asn, p.Ser163Asn, p.Ser163Asn | No | 8.7E−07 |
| 14:24305988:CATAGA:C | c.481_485delTCTAT, c.481_485delTCTAT, c.481_485delTCTAT | p.Ser161fs, p.Ser161fs, p.Ser161fs | Yes | 4.3E−07 |
| 14:24305988:C:T | c.486G > A, c.486G > A, c.486G > A | p.Met162Ile, p.Met162Ile, p.Met162Ile | No | 1.3E−06 |
| 14:24305989:A:G | c.485T > C, c.485T > C, c.485T > C | p.Met162Thr, p.Met162Thr, p.Met162Thr | No | 2.6E−06 |
| 14:24305990:T:A | c.484A > T, c.484A > T, c.484A > T | p.Met162Leu, p.Met162Leu, p.Met162Leu | No | 4.3E−07 |
| 14:24305992:G:A | c.482C > T, c.482C > T, c.482C > T | p.Ser161Phe, p.Ser161Phe, p.Ser161Phe | No | 4.3E−07 |
| 14:24305995:T:C | c.479A > G, c.479A > G, c.479A > G | p.Tyr160Cys, p.Tyr160Cys, p.Tyr160Cys | No | 1.3E−06 |
| 14:24305998:A:G | c.476T > C, c.476T > C, c.476T > C | p.Leu159Pro, p.Leu159Pro, p.Leu159Pro | No | 8.7E−07 |
| 14:24305999:G:A | c.475C > T, c.475C > T, c.475C > T | p.Leu159Phe, p.Leu159Phe, p.Leu159Phe | No | 8.7E−07 |
| 14:24306001:C:T | c.473G > A, c.473G > A, c.473G > A | p.Gly158Glu, p.Gly158Glu, p.Gly158Glu | No | 8.7E−07 |
| 14:24306003:G:T | c.471C > A, c.471C > A, c.471C > A | p.Tyr157*, p.Tyr157*, p.Tyr157* | Yes | 1.3E−06 |
| 14:24306005:A:C | c.469T > G, c.469T > G, c.469T > G | p.Tyr157Asp, p.Tyr157Asp, p.Tyr157Asp | No | 4.3E−07 |
| 14:24306006:G:C | c.468C > G, c.468C > G, c.468C > G | p.Phe156Leu, p.Phe156Leu, p.Phe156Leu | No | 4.3E−07 |
| 14:24306008:A:G | c.466T > C, c.466T > C, c.466T > C | p.Phe156Leu, p.Phe156Leu, p.Phe156Leu | No | 4.3E−07 |
| 14:24306010:G:A | c.464C > T, c.464C > T, c.464C > T | p.Thr155Ile, p.Thr155Ile, p.Thr155Ile | No | 4.3E−07 |
| 14:24306013:G:A | c.461C > T, c.461C > T, c.461C > T | p.Ala154Val, p.Ala154Val, p.Ala154Val | No | 4.3E−07 |
| 14:24306016:T:C | c.458A > G, c.458A > G, c.458A > G | p.Lys153Arg, p.Lys153Arg, p.Lys153Arg | No | 2.6E−06 |
| 14:24306020:C:T | c.454G > A, c.454G > A, c.454G > A | p.Val152Ile, p.Val152Ile, p.Val152Ile | No | 8.7E−07 |
| 14:24306027:G:C | c.447C > G, c.447C > G, c.447C > G | p.Ser149Arg, p.Ser149Arg, p.Ser149Arg | No | 4.3E−07 |
| 14:24306028:CT:C | c.445delA, c.445delA, c.445delA | p.Ser149fs, p.Ser149fs, p.Ser149fs | Yes | 4.3E−07 |
| 14:24306031:C:T | c.443G > A, c.443G > A, c.443G > A | p.Gly148Asp, p.Gly148Asp, p.Gly148Asp | No | 4.3E−07 |
| 14:24306032:C:T | c.442G > A, c.442G > A, c.442G > A | p.Gly148Ser, p.Gly148Ser, p.Gly148Ser | No | 2.2E−06 |
| 14:24306034:A:C | c.440T > G, c.440T > G, c.440T > G | p.Phe147Cys, p.Phe147Cys, p.Phe147Cys | No | 4.3E−07 |
| 14:24306034:A:T | c.440T > A, c.440T > A, c.440T > A | p.Phe147Tyr, p.Phe147Tyr, p.Phe147Tyr | No | 4.3E−07 |
| 14:24306034:A:G | c.440T > C, c.440T > C, c.440T > C | p.Phe147Ser, p.Phe147Ser, p.Phe147Ser | No | 4.3E−07 |
| 14:24306039:G:C | c.435C > G, c.435C > G, c.435C > G | p.Asp145Glu, p.Asp145Glu, p.Asp145Glu | No | 2.2E−06 |
| 14:24306039:G:T | c.435C > A, c.435C > A, c.435C > A | p.Asp145Glu, p.Asp145Glu, p.Asp145Glu | No | 8.7E−07 |
| 14:24306041:C:T | c.433G > A, c.433G > A, c.433G > A | p.Asp145Asn, p.Asp145Asn, p.Asp145Asn | No | 8.7E−07 |
| 14:24306043:C:A | c.431G > T, c.431G > T, c.431G > T | p.Arg144Leu, p.Arg144Leu, p.Arg144Leu | No | 8.7E−07 |
| 14:24306043:C:T | c.431G > A, c.431G > A, c.431G > A | p.Arg144Gln, p.Arg144Gln, p.Arg144Gln | No | 4.3E−06 |
| 14:24306043:C:G | c.431G > C, c.431G > C, c.431G > C | p.Arg144Pro, p.Arg144Pro, p.Arg144Pro | No | 1.7E−06 |
| 14:24306044:G:C | c.430C > G, c.430C > G, c.430C > G | p.Arg144Gly, p.Arg144Gly, p.Arg144Gly | No | 2.6E−06 |
| 14:24306046:G:A | c.428C > T, c.428C > T, c.428C > T | p.Pro143Leu, p.Pro143Leu, p.Pro143Leu | No | 4.3E−07 |
| 14:24306047:G:T | c.427C > A, c.427C > A, c.427C > A | p.Pro143Thr, p.Pro143Thr, p.Pro143Thr | No | 4.3E−07 |
| 14:24306051:T:G | c.423A > C, c.423A > C, c.423A > C | p.Gln141His, p.Gln141His, p.Gln141His | No | 4.3E−07 |
| 14:24306057:G:C | c.417C > G, c.417C > G, c.417C > G | p.Tyr139*, p.Tyr139*, p.Tyr139* | Yes | 4.3E−07 |

TABLE 23-continued

Missense or pLOF variants of CIDEB that were identified by exome sequencing and included in the gene burden association analyses

| Genomic coordinates for the genetic variant, C:P:R:A | Coding DNA change | Protein change | Variant classified as pLOF | AAF, fraction of 1 |
|---|---|---|---|---|
| 14:24306057:G:T | c.417C > A, c.417C > A, c.417C > A | p.Tyr139*, p.Tyr139*, p.Tyr139* | Yes | 4.3E−07 |
| 14:24306058:T:C | c.416A > G, c.416A > G, c.416A > G | p.Tyr139Cys, p.Tyr139Cys, p.Tyr139Cys | No | 1.3E−06 |
| 14:24306059:AC:A | c.414delG, c.414delG, c.414delG | p.Tyr139fs, p.Tyr139fs, p.Tyr139fs | Yes | 4.3E−07 |
| 14:24306061:AC:A | c.412delG, c.412delG, c.412delG | p.Val138fs, p.Val138fs, p.Val138fs | Yes | 4.3E−07 |
| 14:24306062:CGTCAAAG:C | c.405_411delCTTTGAC, c.405_411delCTTTGAC, c.405_411delCTTTGAC | p.Phe136fs, p.Phe136fs, p.Phe136fs | Yes | 8.7E−07 |
| 14:24306063:G:T | c.411C > A, c.411C > A, c.411C > A | p.Asp137Glu, p.Asp137Glu, p.Asp137Glu | No | 2.2E−06 |
| 14:24306064:T:G | c.410A > C, c.410A > C, c.410A > C | p.Asp137Ala, p.Asp137Ala, p.Asp137Ala | No | 4.3E−07 |
| 14:24306065:C:G | c.409G > C, c.409G > C, c.409G > C | p.Asp137His, p.Asp137His, p.Asp137His | No | 8.7E−07 |
| 14:24306066:A:C | c.408T > G, c.408T > G, c.408T > G | p.Phe136Leu, p.Phe136Leu, p.Phe136Leu | No | 4.3E−07 |
| 14:24306070:G:A | c.404C > T, c.404C > T, c.404C > T | p.Thr135Ile, p.Thr135Ile, p.Thr135Ile | No | 1.3E−06 |
| 14:24306072:G:T | c.402C > A, c.402C > A, c.402C > A | p.Phe134Leu, p.Phe134Leu, p.Phe134Leu | No | 4.3E−07 |
| 14:24306074:A:T | c.400T > A, c.400T > A, c.400T > A | p.Phe134Ile, p.Phe134Ile, p.Phe134Ile | No | 8.7E−07 |
| 14:24306074:A:G | c.400T > C, c.400T > C, c.400T > C | p.Phe134Leu, p.Phe134Leu, p.Phe134Leu | No | 4.3E−07 |
| 14:24306077:G:C | c.397C > G, c.397C > G, c.397C > G | p.Arg133Gly, p.Arg133Gly, p.Arg133Gly | No | 4.3E−07 |
| 14:24306083:T:C | c.391A > G, c.391A > G, c.391A > G | p.Ile131Val, p.Ile131Val, p.Ile131Val | No | 4.3E−07 |
| 14:24306086:C:T | c.388G > A, c.388G > A, c.388G > A | p.Asp130Asn, p.Asp130Asn, p.Asp130Asn | No | 1.3E−06 |
| 14:24306089:T:G | c.385A > C, c.385A > C, c.385A > C | p.Lys129Gln, p.Lys129Gln, p.Lys129Gln | No | 4.3E−07 |
| 14:24306092:T:A | c.382A > T, c.382A > T, c.382A > T | p.Ser128Cys, p.Ser128Cys, p.Ser128Cys | No | 4.3E−07 |
| 14:24306092:T:C | c.382A > G, c.382A > G, c.382A > G | p.Ser128Gly, p.Ser128Gly, p.Ser128Gly | No | 1.3E−06 |
| 14:24306092:T:G | c.382A > C, c.382A > C, c.382A > C | p.Ser128Arg, p.Ser128Arg, p.Ser128Arg | No | 4.3E−07 |
| 14:24306097:T:C | c.377A > G, c.377A > G, c.377A > G | p.Lys126Arg, p.Lys126Arg, p.Lys126Arg | No | 1.3E−06 |
| 14:24306098:T:C | c.376A > G, c.376A > G, c.376A > G | p.Lys126Glu, p.Lys126Glu, p.Lys126Glu | No | 4.3E−07 |
| 14:24306103:C:T | c.371G > A, c.371G > A, c.371G > A | p.Arg124Lys, p.Arg124Lys, p.Arg124Lys | No | 8.7E−07 |
| 14:24306105:CTCCCG:C | c.364_368delCGGGA, c.364_368delCGGGA, c.364_368delCGGGA | p.Arg122fs, p.Arg122fs, p.Arg122fs | Yes | 4.3E−07 |
| 14:24306107:C:T | c.367G > A, c.367G > A, c.367G > A | p.Glu123Lys, p.Glu123Lys, p.Glu123Lys | No | 2.1E−05 |
| 14:24306112:C:A | c.362G > T, c.362G > T, c.362G > T | p.Gly121Val, p.Gly121Val, p.Gly121Val | No | 8.7E−07 |
| 14:24306115:A:G | c.359T > C, c.359T > C, c.359T > C | p.Leu120Pro, p.Leu120Pro, p.Leu120Pro | No | 4.3E−07 |
| 14:24306118:C:G | c.356G > C, c.356G > C, c.356G > C | p.Gly119Ala, p.Gly119Ala, p.Gly119Ala | No | 4.3E−07 |
| 14:24306121:T:C | c.353A > G, c.353A > G, c.353A > G | p.Tyr118Cys, p.Tyr118Cys, p.Tyr118Cys | No | 4.3E−07 |
| 14:24306122:A:G | c.352T > C, c.352T > C, c.352T > C | p.Tyr118His, p.Tyr118His, p.Tyr118His | No | 2.2E−06 |
| 14:24306126:CAG:C | c.346_347delCT, c.346_347delCT, c.346_347delCT | p.Leu116fs, p.Leu116fs, p.Leu116fs | Yes | 4.3E−07 |
| 14:24306127:A:G | c.347T > C, c.347T > C, c.347T > C | p.Leu116Pro, p.Leu116Pro, p.Leu116Pro | No | 4.3E−07 |
| 14:24306139:T:G | c.337 − 2A > C, c.337 − 2A > C, c.337 − 2A > C | | Yes | 4.3E−07 |
| 14:24306373:C:G | c.336 + 1G > C, c.336 + 1G > C, c.336 + 1G > C | | Yes | 2.2E−06 |
| 14:24306374:C:G | c.336G > C, c.336G > C, c.336G > C | p.Arg112Ser, p.Arg112Ser, p.Arg112Ser | No | 4.3E−06 |
| 14:24306375:C:T | c.335G > A, c.335G > A, c.335G > A | p.Arg112Lys, p.Arg112Lys, p.Arg112Lys | No | 1.7E−06 |
| 14:24306382:G:T | c.328C > A, c.328C > A, c.328C > A | p.Pro110Thr, p.Pro110Thr, p.Pro110Thr | No | 1.7E−05 |
| 14:24306383:G:T | c.327C > A, c.327C > A, c.327C > A | p.Ser109Arg, p.Ser109Arg, p.Ser109Arg | No | 4.3E−07 |
| 14:24306384:C:G | c.326G > C, c.326G > C, c.326G > C | p.Ser109Thr, p.Ser109Thr, p.Ser109Thr | No | 4.3E−07 |
| 14:24306384:C:T | c.326G > A, c.326G > A, c.326G > A | p.Ser109Asn, p.Ser109Asn, p.Ser109Asn | No | 1.7E−06 |
| 14:24306386:C:G | c.324G > C, c.324G > C, c.324G > C | p.Trp108Cys, p.Trp108Cys, p.Trp108Cys | No | 1.3E−06 |
| 14:24306388:A:G | c.322T > C, c.322T > C, c.322T > C | p.Trp108Arg, p.Trp108Arg, p.Trp108Arg | No | 1.3E−06 |
| 14:24306391:T:C | c.319A > G, c.319A > G, c.319A > G | p.Ser107Gly, p.Ser107Gly, p.Ser107Gly | No | 4.3E−07 |
| 14:24306392:C:G | c.318G > C, c.318G > C, c.318G > C | p.Gln106His, p.Gln106His, p.Gln106His | No | 4.3E−07 |
| 14:24306397:C:T | c.313G > A, c.313G > A, c.313G > A | p.Gly105Ser, p.Gly105Ser, p.Gly105Ser | No | 8.7E−07 |
| 14:24306399:G:A | c.311C > T, c.311C > T, c.311C > T | p.Ser104Phe, p.Ser104Phe, p.Ser104Phe | No | 1.7E−06 |
| 14:24306402:T:A | c.308A > T, c.308A > T, c.308A > T | p.Gln103Leu, p.Gln103Leu, p.Gln103Leu | No | 2.6E−06 |
| 14:24306408:A:G | c.302T > C, c.302T > C, c.302T > C | p.Val101Ala, p.Val101Ala, p.Val101Ala | No | 3.9E−06 |
| 14:24306409:C:G | c.301G > C, c.301G > C, c.301G > C | p.Val101Leu, p.Val101Leu, p.Val101Leu | No | 4.3E−07 |
| 14:24306411:A:G | c.299T > C, c.299T > C, c.299T > C | p.Met100Thr, p.Met100Thr, p.Met100Thr | No | 1.7E−06 |
| 14:24306422:G:C | c.288C > G, c.288C > G, c.288C > G | p.Asp96Glu, p.Asp96Glu, p.Asp96Glu | No | 8.7E−07 |
| 14:24306423:T:C | c.287A > G, c.287A > G, c.287A > G | p.Asp96Gly, p.Asp96Gly, p.Asp96Gly | No | 4.3E−07 |
| 14:24306424:C:T | c.286G > A, c.286G > A, c.286G > A | p.Asp96Asn, p.Asp96Asn, p.Asp96Asn | No | 1.3E−06 |
| 14:24306426:T:G | c.284A > C, c.284A > C, c.284A > C | p.Asp95Ala, p.Asp95Ala, p.Asp95Ala | No | 4.3E−07 |
| 14:24306426:TCCTC:T | c.280_283delGAGG, c.280_283delGAGG, c.280_283delGAGG | p.Glu94fs, p.Glu94fs, p.Glu94fs | Yes | 8.7E−07 |
| 14:24306426:T:C | c.284A > G, c.284A > G, c.284A > G | p.Asp95Gly, p.Asp95Gly, p.Asp95Gly | No | 1.7E−06 |
| 14:24306427:C:T | c.283G > A, c.283G > A, c.283G > A | p.Asp95Asn, p.Asp95Asn, p.Asp95Asn | No | 6.1E−06 |
| 14:24306429:T:G | c.281A > C, c.281A > C, c.281A > C | p.Glu94Ala, p.Glu94Ala, p.Glu94Ala | No | 4.3E−07 |
| 14:24306430:C:T | c.280G > A, c.280G > A, c.280G > A | p.Glu94Lys, p.Glu94Lys, p.Glu94Lys | No | 4.3E−07 |
| 14:24306430:C:A | c.280G > T, c.280G > T, c.280G > T | p.Glu94*, p.Glu94*, p.Glu94* | Yes | 4.3E−07 |
| 14:24306430:C:G | c.280G > C, c.280G > C, c.280G > C | p.Glu94Gln, p.Glu94Gln, p.Glu94Gln | No | 4.3E−07 |

TABLE 23-continued

Missense or pLOF variants of CIDEB that were identified by exome sequencing and included in the gene burden association analyses

| Genomic coordinates for the genetic variant, C:P:R:A | Coding DNA change | Protein change | Variant classified as pLOF | AAF, fraction of 1 |
|---|---|---|---|---|
| 14:24306435:A:G | c.275T > C, c.275T > C, c.275T > C | p.Leu92Pro, p.Leu92Pro, p.Leu92Pro | No | 4.3E−07 |
| 14:24306435:A:T | c.275T > A, c.275T > A, c.275T > A | p.Leu92Gln, p.Leu92Gln, p.Leu92Gln | No | 3.0E−06 |
| 14:24306436:G:T | c.274C > A, c.274C > A, c.274C > A | p.Leu92Met, p.Leu92Met, p.Leu92Met | No | 4.3E−07 |
| 14:24306438:T:A | c.272A > T, c.272A > T, c.272A > T | p.Gln91Leu, p.Gln91Leu, p.Gln91Leu | No | 8.7E−07 |
| 14:24306448:C:G | c.262G > C, c.262G > C, c.262G > C | p.Asp88His, p.Asp88His, p.Asp88His | No | 4.3E−07 |
| 14:24306449:C:G | c.261G > C, c.261G > C, c.261G > C | p.Glu87Asp, p.Glu87Asp, p.Glu87Asp | No | 1.3E−06 |
| 14:24306450:T:TC | c.259dupG, c.259dupG, c.259dupG | p.Glu87fs, p.Glu87fs, p.Glu87fs | Yes | 1.7E−05 |
| 14:24306453:C:T | c.257G > A, c.257G > A, c.257G > A | p.Ser86Asn, p.Ser86Asn, p.Ser86Asn | No | 4.3E−07 |
| 14:24306454:T:C | c.256A > G, c.256A > G, c.256A > G | p.Ser86Gly, p.Ser86Gly, p.Ser86Gly | No | 4.3E−07 |
| 14:24306455:G:C | c.255C > G, c.255C > G, c.255C > G | p.Asp85Glu, p.Asp85Glu, p.Asp85Glu | No | 4.3E−07 |
| 14:24306457:C:T | c.253G > A, c.253G > A, c.253G > A | p.Asp85Asn, p.Asp85Asn, p.Asp85Asn | No | 4.3E−07 |
| 14:24306459:A:G | c.251T > C, c.251T > C, c.251T > C | p.Val84Ala, p.Val84Ala, p.Val84Ala | No | 8.7E−07 |
| 14:24306460:C:T | c.250G > A, c.250G > A, c.250G > A | p.Val84Met, p.Val84Met, p.Val84Met | No | 1.3E−06 |
| 14:24306467:TC:T | c.242delG, c.242delG, c.242delG | p.Gly81fs, p.Gly81fs, p.Gly81fs | Yes | 4.3E−07 |
| 14:24306468:C:G | c.242G > C, c.242G > C, c.242G > C | p.Gly81Ala, p.Gly81Ala, p.Gly81Ala | No | 1.7E−06 |
| 14:24306469:C:G | c.241G > C, c.241G > C, c.241G > C | p.Gly81Arg, p.Gly81Arg, p.Gly81Arg | No | 4.3E−07 |
| 14:24306470:A:C | c.240T > G, c.240T > G, c.240T > G | p.Asp80Glu, p.Asp80Glu, p.Asp80Glu | No | 4.3E−07 |
| 14:24306472:C:T | c.238G > A, c.238G > A, c.238G > A | p.Asp80Asn, p.Asp80Asn, p.Asp80Asn | No | 8.7E−07 |
| 14:24306474:T:C | c.236A > G, c.236A > G, c.236A > G | p.Glu79Gly, p.Glu79Gly, p.Glu79Gly | No | 8.7E−07 |
| 14:24306475:C:T | c.235G > A, c.235G > A, c.235G > A | p.Glu79Lys, p.Glu79Lys, p.Glu79Lys | No | 2.2E−06 |
| 14:24306483:A:T | c.227T > A, c.227T > A, c.227T > A | p.Val76Glu, p.Val76Glu, p.Val76Glu | No | 1.7E−06 |
| 14:24306489:G:A | c.221C > T, c.221C > T, c.221C > T | p.Thr74Ile, p.Thr74Ile, p.Thr74Ile | No | 1.3E−06 |
| 14:24306489:G:T | c.221C > A, c.221C > A, c.221C > A | p.Thr74Asn, p.Thr74Asn, p.Thr74Asn | No | 2.6E−06 |
| 14:24306498:C:T | c.212G > A, c.212G > A, c.212G > A | p.Gly71Glu, p.Gly71Glu, p.Gly71Glu | No | 4.3E−07 |
| 14:24306507:A:G | c.203T > C, c.203T > C, c.203T > C | p.Leu68Pro, p.Leu68Pro, p.Leu68Pro | No | 2.6E−06 |
| 14:24306513:G:GC | c.196_197insG, c.196_197insG, c.196_197insG | p.Thr66fs, p.Thr66fs, p.Thr66fs | Yes | 4.3E−07 |
| 14:24306513:GT:G | c.196delA, c.196delA, c.196delA | p.Thr66fs, p.Thr66fs, p.Thr66fs | Yes | 1.7E−05 |
| 14:24306514:T:A | c.196A > T, c.196A > T, c.196A > T | p.Thr66Ser, p.Thr66Ser, p.Thr66Ser | No | 1.3E−06 |
| 14:24306517:C:T | c.193G > A, c.193G > A, c.193G > A | p.Glu65Lys, p.Glu65Lys, p.Glu65Lys | No | 3.0E−06 |
| 14:24306519:A:T | c.191T > A, c.191T > A, c.191T > A | p.Leu64*, p.Leu64*, p.Leu64* | Yes | 4.3E−07 |
| 14:24306519:A:G | c.191T > C, c.191T > C, c.191T > C | p.Leu64Ser, p.Leu64Ser, p.Leu64Ser | No | 8.7E−07 |
| 14:24306522:G:T | c.188C > A, c.188C > A, c.188C > A | p.Ala63Glu, p.Ala63Glu, p.Ala63Glu | No | 3.0E−06 |
| 14:24306524:C:T | c.187 − 1G > A, c.187 − 1G > A, c.187 − 1G > A | | Yes | 4.3E−07 |
| 14:24306525:T:C | c.187 − 2A > G, c.187 − 2A > G, c.187 − 2A > G | | Yes | 8.7E−07 |
| 14:24307369:A:C | c.186 + 2T > G, c.186 + 2T > G, c.186 + 2T > G | | Yes | 2.6E−06 |
| 14:24307370:C:T | c.186 + 1G > A, c.186 + 1G > A, c.186 + 1G > A | | Yes | 4.3E−07 |
| 14:24307370:C:A | c.186 + 1G > T, c.186 + 1G > T, c.186 + 1G > T | | Yes | 4.3E−07 |
| 14:24307372:T:C | c.185A > G, c.185A > G, c.185A > G | p.Lys62Arg, p.Lys62Arg, p.Lys62Arg | No | 1.7E−06 |
| 14:24307373:T:C | c.184A > G, c.184A > G, c.184A > G | p.Lys62Glu, p.Lys62Glu, p.Lys62Glu | No | 4.3E−07 |
| 14:24307375:GC:G | c.181delG, c.181delG, c.181delG | p.Ala61fs, p.Ala61fs, p.Ala61fs | Yes | 1.7E−06 |
| 14:24307376:C:T | c.181G > A, c.181G > A, c.181G > A | p.Ala61Thr, p.Ala61Thr, p.Ala61Thr | No | 5.6E−06 |
| 14:24307376:C:G | c.181G > C, c.181G > C, c.181G > C | p.Ala61Pro, p.Ala61Pro, p.Ala61Pro | No | 4.3E−07 |
| 14:24307379:G:C | c.178C > G, c.178C > G, c.178C > G | p.Leu60Val, p.Leu60Val, p.Leu60Val | No | 1.3E−06 |
| 14:24307381:A:C | c.176T > G, c.176T > G, c.176T > G | p.Leu59Arg, p.Leu59Arg, p.Leu59Arg | No | 4.3E−07 |
| 14:24307381:A:G | c.176T > C, c.176T > C, c.176T > C | p.Leu59Pro, p.Leu59Pro, p.Leu59Pro | No | 4.3E−07 |
| 14:24307384:T:C | c.173A > G, c.173A > G, c.173A > G | p.Glu58Gly, p.Glu58Gly, p.Glu58Gly | No | 3.2E−05 |
| 14:24307391:G:T | c.166C > A, c.166C > A, c.166C > A | p.Arg56Ser, p.Arg56Ser, p.Arg56Ser | No | 4.3E−07 |
| 14:24307397:C:G | c.160G > C, c.160G > C, c.160G > C | p.Ala54Pro, p.Ala54Pro, p.Ala54Pro | No | 4.3E−07 |
| 14:24307397:C:T | c.160G > A, c.160G > A, c.160G > A | p.Ala54Thr, p.Ala54Thr, p.Ala54Thr | No | 3.5E−06 |
| 14:24307400:C:T | c.157G > A, c.157G > A, c.157G > A | p.Ala53Thr, p.Ala53Thr, p.Ala53Thr | No | 4.3E−07 |
| 14:24307406:G:T | c.151C > A, c.151C > A, c.151C > A | p.Leu51Met, p.Leu51Met, p.Leu51Met | No | 8.7E−07 |
| 14:24307408:C:A | c.149G > T, c.149G > T, c.149G > T | p.Gly50Val, p.Gly50Val, p.Gly50Val | No | 1.3E−06 |
| 14:24307412:TC:T | c.144delG, c.144delG, c.144delG | p.Gly50fs, p.Gly50fs, p.Gly50fs | Yes | 8.7E−07 |
| 14:24307414:C:T | c.143G > A, c.143G > A, c.143G > A | p.Arg48Gln, p.Arg48Gln, p.Arg48Gln | No | 1.2E−05 |
| 14:24307415:G:C | c.142C > G, c.142C > G, c.142C > G | p.Arg48Gly, p.Arg48Gly, p.Arg48Gly | No | 4.3E−07 |
| 14:24307415:G:A | c.142C > T, c.142C > T, c.142C > T | p.Arg48Trp, p.Arg48Trp, p.Arg48Trp | No | 1.1E−05 |
| 14:24307417:A:T | c.140T > A, c.140T > A, c.140T > A | p.Ile47Asn, p.Ile47Asn, p.Ile47Asn | No | 4.3E−07 |
| 14:24307418:T:C | c.139A > G, c.139A > G, c.139A > G | p.Ile47Val, p.Ile47Val, p.Ile47Val | No | 4.3E−07 |
| 14:24307420:G:T | c.137C > A, c.137C > A, c.137C > A | p.Thr46Asn, p.Thr46Asn, p.Thr46Asn | No | 4.3E−07 |
| 14:24307420:G:A | c.137C > T, c.137C > T, c.137C > T | p.Thr46Ile, p.Thr46Ile, p.Thr46Ile | No | 8.7E−07 |
| 14:24307426:T:A | c.131A > T, c.131A > T, c.131A > T | p.Lys44Met, p.Lys44Met, p.Lys44Met | No | 4.3E−07 |

TABLE 23-continued

Missense or pLOF variants of CIDEB that were identified by exome sequencing and included in the gene burden association analyses

| Genomic coordinates for the genetic variant, C:P:R:A | Coding DNA change | Protein change | Variant classified as pLOF | AAF, fraction of 1 |
|---|---|---|---|---|
| 14:24307428:G:C | c.129C > G, c.129C > G, c.129C > G | p.His43Gln, p.His43Gln, p.His43Gln | No | 4.3E−07 |
| 14:24307432:T:A | c.125A > T, c.125A > T, c.125A > T | p.Asp42Val, p.Asp42Val, p.Asp42Val | No | 6.1E−06 |
| 14:24307435:C:T | c.122G > A, c.122G > A, c.122G > A | p.Cys41Tyr, p.Cys41Tyr, p.Cys41Tyr | No | 4.3E−06 |
| 14:24307436:A:C | c.121T > G, c.121T > G, c.121T > G | p.Cys41Gly, p.Cys41Gly, p.Cys41Gly | No | 1.3E−06 |
| 14:24307436:A:G | c.121T > C, c.121T > C, c.121T > C | p.Cys41Arg, p.Cys41Arg, p.Cys41Arg | No | 4.3E−07 |
| 14:24307437:GAC:G | c.118_119delGT, c.118_119delGT, c.118_119delGT | p.Val40fs, p.Val40fs, p.Val40fs | Yes | 4.3E−07 |
| 14:24307439:C:T | c.118G > A, c.118G > A, c.118G > A | p.Val40Ile, p.Val40Ile, p.Val40Ile | No | 4.3E−07 |
| 14:24307441:C:G | c.116G > C, c.116G > C, c.116G > C | p.Arg39Pro, p.Arg39Pro, p.Arg39Pro | No | 3.0E−06 |
| 14:24307444:A:G | c.113T > C, c.113T > C, c.113T > C | p.Phe38Ser, p.Phe38Ser, p.Phe38Ser | No | 4.3E−06 |
| 14:24307444:A:C | c.113T > G, c.113T > G, c.113T > G | p.Phe38Cys, p.Phe38Cys, p.Phe38Cys | No | 4.3E−07 |
| 14:24307450:C:G | c.107G > C, c.107G > C, c.107G > C | p.Arg36Pro, p.Arg36Pro, p.Arg36Pro | No | 2.6E−06 |
| 14:24307450:C:CGCTG | c.103_106dupCAGC, c.103_106dupCAGC, c.103_106dupCAGC | p.Arg36fs, p.Arg36fs, p.Arg36fs | Yes | 4.3E−07 |
| 14:24307450:C:A | c.107G > T, c.107G > T, c.107G > T | p.Arg36Leu, p.Arg36Leu, p.Arg36Leu | No | 4.3E−07 |
| 14:24307453:T:C | c.104A > G, c.104A > G, c.104A > G | p.Gln35Arg, p.Gln35Arg, p.Gln35Arg | No | 1.7E−06 |
| 14:24307454:G:A | c.103C > T, c.103C > T, c.103C > T | p.Gln35*, p.Gln35*, p.Gln35* | Yes | 4.8E−06 |
| 14:24307459:G:T | c.98C > A, c.98C > A, c.98C > A | p.Pro33Gln, p.Pro33Gln, p.Pro33Gln | No | 4.3E−07 |
| 14:24307465:G:C | c.92C > G, c.92C > G, c.92C > G | p.Ala31Gly, p.Ala31Gly, p.Ala31Gly | No | 4.3E−07 |
| 14:24307466:C:G | c.91G > C, c.91G > C, c.91G > C | p.Ala31Pro, p.Ala31Pro, p.Ala31Pro | No | 4.3E−07 |
| 14:24307468:G:A | c.89C > T, c.89C > T, c.89C > T | p.Ser30Leu, p.Ser30Leu, p.Ser30Leu | No | 4.3E−07 |
| 14:24307472:T:A | c.85A > T, c.85A > T, c.85A > T | p.Thr29Ser, p.Thr29Ser, p.Thr29Ser | No | 4.3E−07 |
| 14:24307473:C:A | c.84G > T, c.84G > T, c.84G > T | p.Trp28Cys, p.Trp28Cys, p.Trp28Cys | No | 4.3E−07 |
| 14:24307474:C:G | c.83G > C, c.83G > C, c.83G > C | p.Trp28Ser, p.Trp28Ser, p.Trp28Ser | No | 4.3E−07 |
| 14:24307474:C:A | c.83G > T, c.83G > T, c.83G > T | p.Trp28Leu, p.Trp28Leu, p.Trp28Leu | No | 2.2E−06 |
| 14:24307477:A:C | c.80T > G, c.80T > G, c.80T > G | p.Val27Gly, p.Val27Gly, p.Val27Gly | No | 4.3E−07 |
| 14:24307478:C:T | c.79G > A, c.79G > A, c.79G > A | p.Val27Ile, p.Val27Ile, p.Val27Ile | No | 3.0E−06 |
| 14:24307480:C:T | c.77G > A, c.77G > A, c.77G > A | p.Arg26Lys, p.Arg26Lys, p.Arg26Lys | No | 1.3E−06 |
| 14:24307486:C:G | c.71G > C, c.71G > C, c.71G > C | p.Gly24Ala, p.Gly24Ala, p.Gly24Ala | No | 4.3E−07 |
| 14:24307486:C:T | c.71G > A, c.71G > A, c.71G > A | p.Gly24Glu, p.Gly24Glu, p.Gly24Glu | No | 1.3E−05 |
| 14:24307489:A:G | c.68T > C, c.68T > C, c.68T > C | p.Phe23Ser, p.Phe23Ser, p.Phe23Ser | No | 1.3E−06 |
| 14:24307489:A:C | c.68T > G, c.68T > G, c.68T > G | p.Phe23Cys, p.Phe23Cys, p.Phe23Cys | No | 8.7E−07 |
| 14:24307490:A:G | c.67T > C, c.67T > C, c.67T > C | p.Phe23Leu, p.Phe23Leu, p.Phe23Leu | No | 1.7E−06 |
| 14:24307498:CTTATA:C | c.54_58delTATAA, c.54_58delTATAA, c.54_58delTATAA | p.Asn18fs, p.Asn18fs, p.Asn18fs | Yes | 2.2E−06 |
| 14:24307501:A:G | c.56T > C, c.56T > C, c.56T > C | p.Ile19Thr, p.Ile19Thr, p.Ile19Thr | No | 3.0E−06 |
| 14:24307502:T:C | c.55A > G, c.55A > G, c.55A > G | p.Ile19Val, p.Ile19Val, p.Ile19Val | No | 1.3E−06 |
| 14:24307502:T:A | c.55A > T, c.55A > T, c.55A > T | p.Ile19Leu, p.Ile19Leu, p.Ile19Leu | No | 8.7E−07 |
| 14:24307502:T:G | c.55A > C, c.55A > C, c.55A > C | p.Ile19Leu, p.Ile19Leu, p.Ile19Leu | No | 8.7E−07 |
| 14:24307507:G:C | c.50C > G, c.50C > G, c.50C > G | p.Ser17Cys, p.Ser17Cys, p.Ser17Cys | No | 1.7E−06 |
| 14:24307508:A:C | c.49T > G, c.49T > G, c.49T > G | p.Ser17Ala, p.Ser17Ala, p.Ser17Ala | No | 4.3E−07 |
| 14:24307510:A:G | c.47T > C, c.47T > C, c.47T > C | p.Val16Ala, p.Val16Ala, p.Val16Ala | No | 1.3E−06 |
| 14:24307511:C:T | c.46G > A, c.46G > A, c.46G > A | p.Val16Ile, p.Val16Ile, p.Val16Ile | No | 1.3E−06 |
| 14:24307514:A:AC | c.42dupG, c.42dupG, c.42dupG | p.Ser15fs, p.Ser15fs, p.Ser15fs | Yes | 1.3E−06 |
| 14:24307515:C:G | c.42G > C, c.42G > C, c.42G > C | p.Arg14Ser, p.Arg14Ser, p.Arg14Ser | No | 8.7E−07 |
| 14:24307516:C:A | c.42 − 1G > T, c.42 − 1G > T, c.42 − 1G > T | | Yes | 2.6E−06 |
| 14:24307516:C:T | c.42 − 1G > A, c.42 − 1G > A, c.42 − 1G > A | | Yes | 8.7E−07 |
| 14:24307818:C:T | c.41G > A, c.41G > A, c.41G > A | p.Arg14Lys, p.Arg14Lys, p.Arg14Lys | No | 4.3E−07 |
| 14:24307818:CTGAG:C | c.37_40delCTCA, c.37_40delCTCA, c.37_40delCTCA | p.Leu13fs, p.Leu13fs, p.Leu13fs | Yes | 4.3E−07 |
| 14:24307819:T:C | c.40A > G, c.40A > G, c.40A > G | p.Arg14Gly, p.Arg14Gly, p.Arg14Gly | No | 3.0E−06 |
| 14:24307822:G:A | c.37C > T, c.37C > T, c.37C > T | p.Leu13Phe, p.Leu13Phe, p.Leu13Phe | No | 1.3E−06 |
| 14:24307830:CTG:C | c.27_28delCA, c.27_28delCA, c.27_28delCA | p.Ser10fs, p.Ser10fs, p.Ser10fs | Yes | 4.3E−06 |
| 14:24307830:C:T | c.29G > A, c.29G > A, c.29G > A | p.Ser10Asn, p.Ser10Asn, p.Ser10Asn | No | 1.3E−06 |
| 14:24307834:G:A | c.25C > T, c.25C > T, c.25C > T | p.Pro9Ser, p.Pro9Ser, p.Pro9Ser | No | 8.7E−07 |
| 14:24307835:G:T | c.24C > A, c.24C > A, c.24C > A | p.Asn8Lys, p.Asn8Lys, p.Asn8Lys | No | 8.7E−07 |
| 14:24307837:T:G | c.22A > C, c.22A > C, c.22A > C | p.Asn8His, p.Asn8His, p.Asn8His | No | 4.3E−06 |
| 14:24307840:C:G | c.19C > G, c.19C > G, c.19C > G | p.Leu7Val, p.Leu7Val, p.Leu7Val | No | 4.3E−07 |
| 14:24307842:G:A | c.17C > T, c.17C > T, c.17C > T | p.Ala6Val, p.Ala6Val, p.Ala6Val | No | 2.6E−06 |
| 14:24307843:C:T | c.16G > A, c.16G > A, c.16G > A | p.Ala6Thr, p.Ala6Thr, p.Ala6Thr | No | 4.3E−07 |
| 14:24307848:A:G | c.11T > C, c.11T > C, c.11T > C | p.Leu4Pro, p.Leu4Pro, p.Leu4Pro | No | 4.3E−07 |
| 14:24307849:G:C | c.10C > G, c.10C > G, c.10C > G | p.Leu4Val, p.Leu4Val, p.Leu4Val | No | 4.3E−07 |
| 14:24307849:G:A | c.10C > T, c.10C > T, c.10C > T | p.Leu4Phe, p.Leu4Phe, p.Leu4Phe | No | 4.3E−07 |

TABLE 23-continued

Missense or pLOF variants of CIDEB that were identified by exome sequencing and included in the gene burden association analyses

| Genomic coordinates for the genetic variant, C:P:R:A | Coding DNA change | Protein change | Variant classified as pLOF | AAF, fraction of 1 |
|---|---|---|---|---|
| 14:24307850:G:C | c.9C > G, c.9C > G, c.9C > G | p.Tyr3*, p.Tyr3*, p.Tyr3* | Yes | 4.3E−07 |
| 14:24307851:T:TA | c.7dupT, c.7dupT, c.7dupT | p.Tyr3fs, p.Tyr3fs, p.Tyr3fs | Yes | 4.3E−07 |
| 14:24307852:A:G | c.7T > C, c.7T > C, c.7T > C | p.Tyr3His, p.Tyr3His, p.Tyr3His | No | 3.5E−06 |
| 14:24307853:C:G | c.6G > C, c.6G > C, c.6G > C | p.Glu2Asp, p.Glu2Asp, p.Glu2Asp | No | 1.3E−06 |
| 14:24307853:C:A | c.6G > T, c.6G > T, c.6G > T | p.Glu2Asp, p.Glu2Asp, p.Glu2Asp | No | 8.7E−07 |
| 14:24307856:CATGG:C | c.−2__2delCCAT, c.−2__2delCCAT, c.−2__2delCCAT | p.Met1fs, p.Met1fs, p.Met1fs | Yes | 4.3E−07 |
| 14:24307856:C:T | c.3G > A, c.3G > A, c.3G > A | p.Met1?, p.Met1?, p.Met1? | Yes | 4.8E−06 |
| 14:24307857:A:T | c.2T > A, c.2T > A, c.2T > A | p.Met1?, p.Met1?, p.Met1? | Yes | 4.3E−07 |
| 14:24307857:A:G | c.2T > C, c.2T > C, c.2T > C | p.Met1?, p.Met1?, p.Met1? | Yes | 8.7E−07 |
| 14:24307858:T:C | c.1A > G, c.1A > G, c.1A > G | p.Met1?, p.Met1?, p.Met1? | Yes | 1.3E−06 |
| 14:24307921:C:A | c.−62 − 1G > T, c.−62 − 1G > T | | Yes | 1.3E−06 |
| 14:24307921:C:T | c.−62 − 1G > A, c.−62 − 1G > A | | Yes | 1.3E−06 |
| 14:24307921:CT:C | c.−62 − 2delA, c.−62 − 2delA | | Yes | 4.3E−07 |

C:P:R:A indicates the genomic coordinates of the genetic variant including chromosome (C), physical genomic position in base pairs (P), reference allele (R) and alternative allele (A) relative to build 38 of the Human Genome sequence by the Human Genome Reference Consortium. Coding DNA and protein changes follow the Human Genome Variation Society nomenclature and refer to three CIDEB transcripts annotated in the in the Ensembl database (URL: https://useast.ensembl.org/index.html). Annotations on these three transcripts are reported in the Table 23 in the following order: ENST00000258807, ENST00000554411, ENST00000336557. AAF indicates the alternative allele frequency. pLOF indicates predicted loss of function variant.

Example 3: Interaction of CIDEB Rare Coding Variants with Body Mass Index

Figure 4:
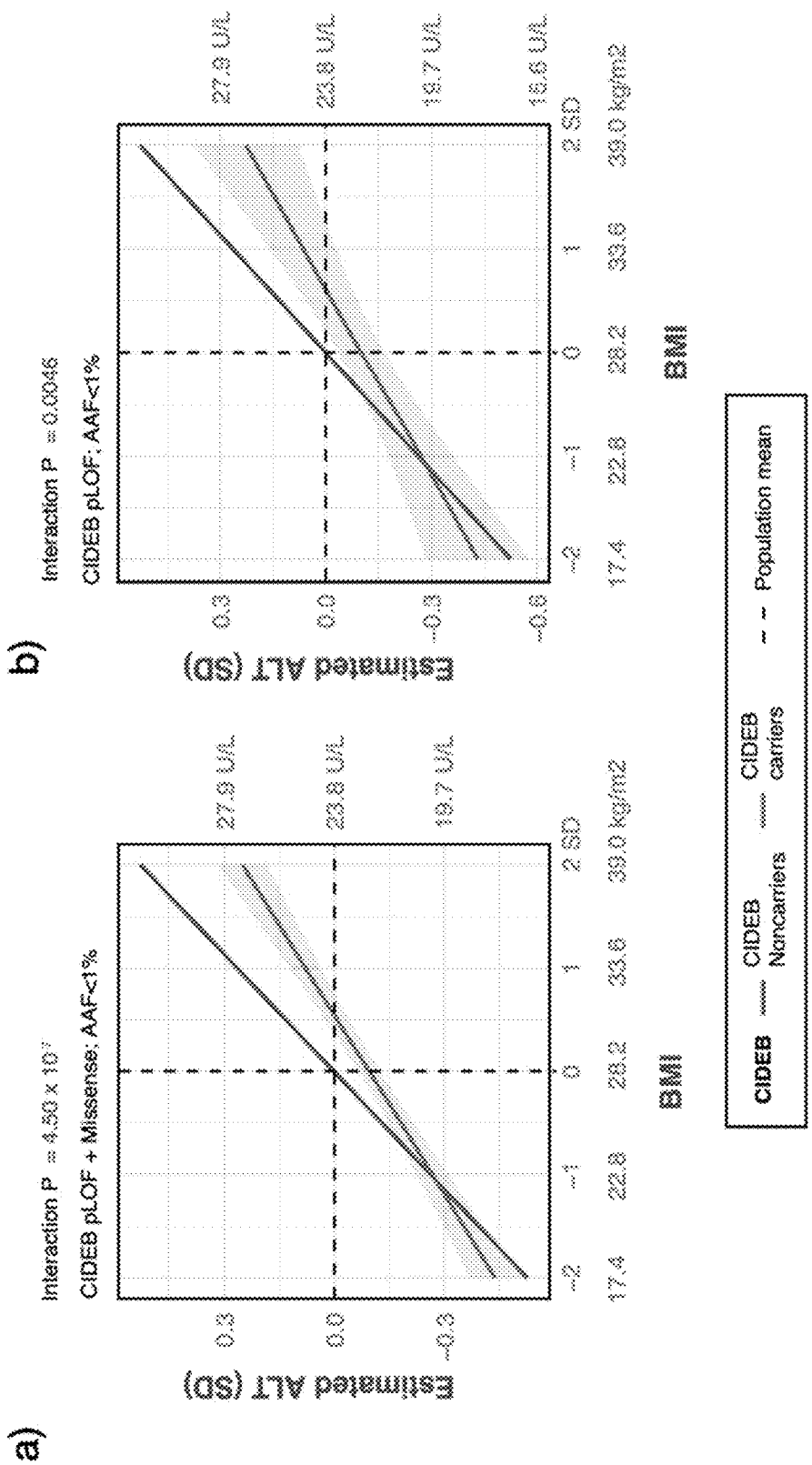
FIG. 4 shows a visualization of the interaction between the burden of rare coding variants in CIDEB and body mass index on alanine aminotransferase levels. CIDEB rare coding (pLOF and missense) variants (Panel a) and CIDEB rare pLOF variants alone (Panel b) were associated with a larger decrease in ALT when individuals have higher body mass index compared to individuals with a lower body mass index. Interaction p-values were used to determine whether this difference in association with ALT by BMI was statistically significant. Abbreviations: ALT, alanine aminotransferase; BMI, body mass index; pLOF, predicted loss of function; AAF, alternate allele frequency; SD, standard deviation; U/L, units per liter.

It was hypothesized that rare coding variants in CIDEB may protect from liver disease by preventing excessive build-up of liver fat into enlarged and inflammation-prone lipid droplets. If that were the case, the protective association of CIDEB rare pLOF and missense variants might be stronger in individuals with higher adiposity who are exposed to a higher risk of liver steatosis and injury. Thus, interactions for rare coding variants in CIDEB with body mass index (BMI), the principal epidemiological risk factor for liver steatosis, were estimated. The association of CIDEB rare coding variants with lower ALT was amplified in individuals with higher BMI when BMI was modelled as a continuous variable ($p_{interaction}$=4.5×10$^{-7}$ rare pLOF plus missense variants in CIDEB and $P_{interaction}$=0.0046 for pLOF variants in CIDEB, as shown in FIG. 4).

Figure 5:
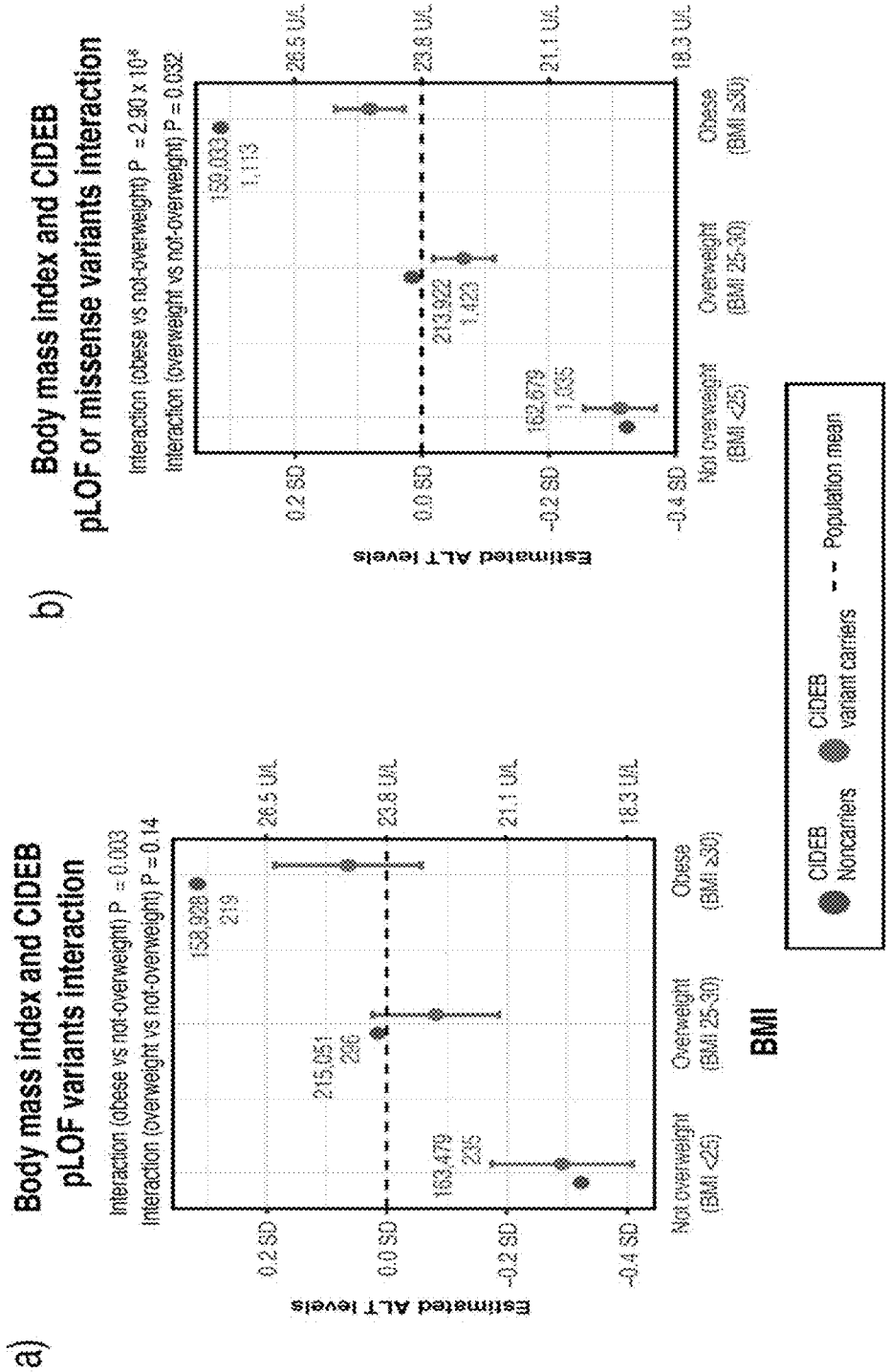
FIG. 5 shows a visualization of the interaction between rare coding variants in CIDEB and body mass index. Panel a shows the interaction of CIDEB genotype (i.e., rare pLOF variants) and body mass index on alanine aminotransferase level. Panel b shows the interaction of CIDEB genotype (i.e., rare pLOF and missense variants) and body mass index on alanine aminotransferase level. Abbreviations: pLOF, predicted loss of function; SD, standard deviation; P, p-value; ALT, alanine aminotransferase; BMI, body mass index; U/L, units per liter.

An interaction on ALT between rare coding variants in CIDEB and clinical categories of BMI was identified. Specifically, CIDEB rare coding variants were not associated with ALT levels in non-overweight individuals (per-allele beta in U/L, 0.1; 95% CI, −0.7 to 0.8; p=0.85), but were associated with −2.8 U/L lower ALT in obese individuals (95% CI, −3.6 to −2.1; p=1.7×10$^{-13}$; $p_{interaction}$ with BMI category=2.9×10$^{-8}$; FIG. 5, panel a and Table 24). This interaction was also observed for CIDEB pLOF variants (FIG. 5, panel b and Table 24). Therefore, the protective association against liver damage observed in carriers of rare pLOF variants in CIDEB is greater in individuals with higher body mass index or who are categorically classified as overweight or obese.

TABLE 24

Interaction between rare pLOF or missense variants in CIDEB and BMI on ALT levels (genetic exposure for first three data lines = burden of pLOF or missense variants in CIDEB with AAF <1%; genetic exposure for last three data lines = burden of pLOF variants in CIDEB with AAF <1%)

| BMI category | Per allele beta (95% CI) in SD units of ALT levels | p-value | Genotype counts, RR\|RA\|AA genotypes | Interaction beta (95% CI) in SD units of ALT per each additional CIDEB allele and kg/m$^2$ unit of BMI | p-value for linear interaction between CIDEB genotype and BMI |
|---|---|---|---|---|---|
| Not Overweight (<25 kg/m2) | −0.01 (−0.05, 0.06) | 8.5 × 10$^{-1}$ | 162,679\|1,035\|0 | −0.08 (−0.11, −0.05) | 4.5 × 10$^{-7}$ |

TABLE 24-continued

Interaction between rare pLOF or missense variants in CIDEB and BMI on ALT levels (genetic exposure for first three data lines = burden of pLOF or missense variants in CIDEB with AAF <1%; genetic exposure for last three data lines = burden of pLOF variants in CIDEB with AAF <1%)

| BMI category | Per allele beta (95% CI) in SD units of ALT levels | p-value | Genotype counts, RR\|RA\|AA genotypes | Interaction beta (95% CI) in SD units of ALT per each additional CIDEB allele and kg/m$^2$ unit of BMI | p-value for linear interaction between CIDEB genotype and BMI |
|---|---|---|---|---|---|
| Overweight (25 to <30 kg/m2) | −0.08 (−0.13, −0.03) | $7.9 \times 10^{-4}$ | 213,922\|1,423\|2 | | |
| Obese (≥30 kg/m2) | −0.21 (−0.26, −0.15) | $1.7 \times 10^{-13}$ | 159,033\|1,113\|1 | | |
| Not Overweight (<25 kg/m2) | 0.03 (−0.08, 0.15) | $5.7 \times 10^{-1}$ | 163,479\|235\|0 | −0.10 (−0.16, −0.03) | $4.6 \times 10^{-3}$ |
| Overweight (25 to <30 kg/m2) | −0.10 (−0.21, 0.00) | $5.8 \times 10^{-2}$ | 215,051\|296\|0 | | |
| Obese (≥30 kg/m2) | −0.25 (−0.37, −0.12) | $8.5 \times 10^{-5}$ | 159,928\|219\|0 | | |

BMI indicates body mass index. BMI categories were defined according to the World Health Organization as follows: "non-overweight" (BMI<25 kg/m$^2$), "overweight" (BMI≥25 and <30 kg/m$^2$), "obesity" (BMI≥30). RR indicates the number of individuals carrying no rare missense or pLOF variants in CIDEB (homozygous non-carriers); RA indicates the number of individuals carrying rare missense or pLOF variants in a single CIDEB allele (heterozygous carriers); AA indicates the number of individuals carrying rare missense or pLOF variants in both CIDEB alleles (homozygous carriers); SD indicates standard deviation units; AAF indicates the alternative allele frequency; pLOF indicates predicted loss of function; CI indicates confidence interval; kg/m$^2$ kilograms per square meter.

Table 24 shows the association with ALT levels of rare pLOF or missense variants in CIDEB within BMI categories in a meta-analysis of the GHS and UKB cohorts and the estimates from the linear interaction analysis.

Given the significant interactions for CIDEB with BMI (this example) and PNPLA3 (Example 4) on ALT and potential for CIDEB to affect liver fat through experimental evidence (Example 5), it was hypothesized that rare coding variants in CIDEB are associated with liver fat and that the association is more pronounced in overweight individuals. Rare coding variants in CIDEB were significantly associated with MRI-measured liver fat (Table 25): rare pLOF variants were associated with lower liver fat in overweight or obese individuals (per-allele beta in % units of liver fat fraction, −1.5%; 95% CI, −3.0% to −0.1%; p=0.04). In addition, a significant interaction was found between rare pLOF or missense variants in CIDEB and BMI on MRI-measured liver fat (p-interaction=0.02).

TABLE 25

Association results for the interaction between carriers of rare coding variant in CIDEB and overweight or obese individuals on MRI measured liver fat

| Exposure | Beta (95% CI) in SD units per allele | Clinical units, % liver fat fraction | P | Allele count |
|---|---|---|---|---|
| CIDEB (pLOF; AAF <1%) in not-overweight individuals | 0.10 (−0.30, 0.51) | 0.51 (−1.46, 2.49) | 0.61 | 14,892\|19\|0 |
| CIDEB (pLOF; AAF <1%) in Overweight or Obese individuals | −0.31 (−0.61, −0.02) | −1.54 (−2.99, −0.08) | 0.04 | 22,261\|35\|0 |
| Interaction estimate of CIDEB (pLOF; AAF <1%) * Overweight or obese | −0.42 (−0.92, 0.08) | −2.05 (−4.49, 0.40) | 0.10 | |
| CIDEB (pLOF + missense variants; AAF <1%) in not-overweight individuals | 0.18 (−0.02, 0.37) | 0.88 (−0.08, 1.84) | 0.07 | 14,947\|79\|0 |
| CIDEB (pLOF + missense variants; AAF <1%) in Overweight or Obese individuals | −0.12 (−0.27, 0.02) | −0.60 (−1.31, 0.12) | 0.10 | 22,357\|143\|0 |
| Interaction estimate of CIDEB (pLOF + missense variants; AAF <1%) * Overweight or obese | −0.30 (−0.54, −0.05) | −1.45 (−2.67, −0.23) | 0.02 | |

A linear regression was performed between PDFF and CIDEB rare coding variants within not-overweight and overweight or obese individuals separately. Interaction estimates were calculated in the full model, in each ancestry separately and meta-analyzed—same as the discovery analysis. Abbreviations: pLOF, predicted loss of function; SD, standard deviation; P, p-value; AAF, alternate allele frequency.

Figure 6:
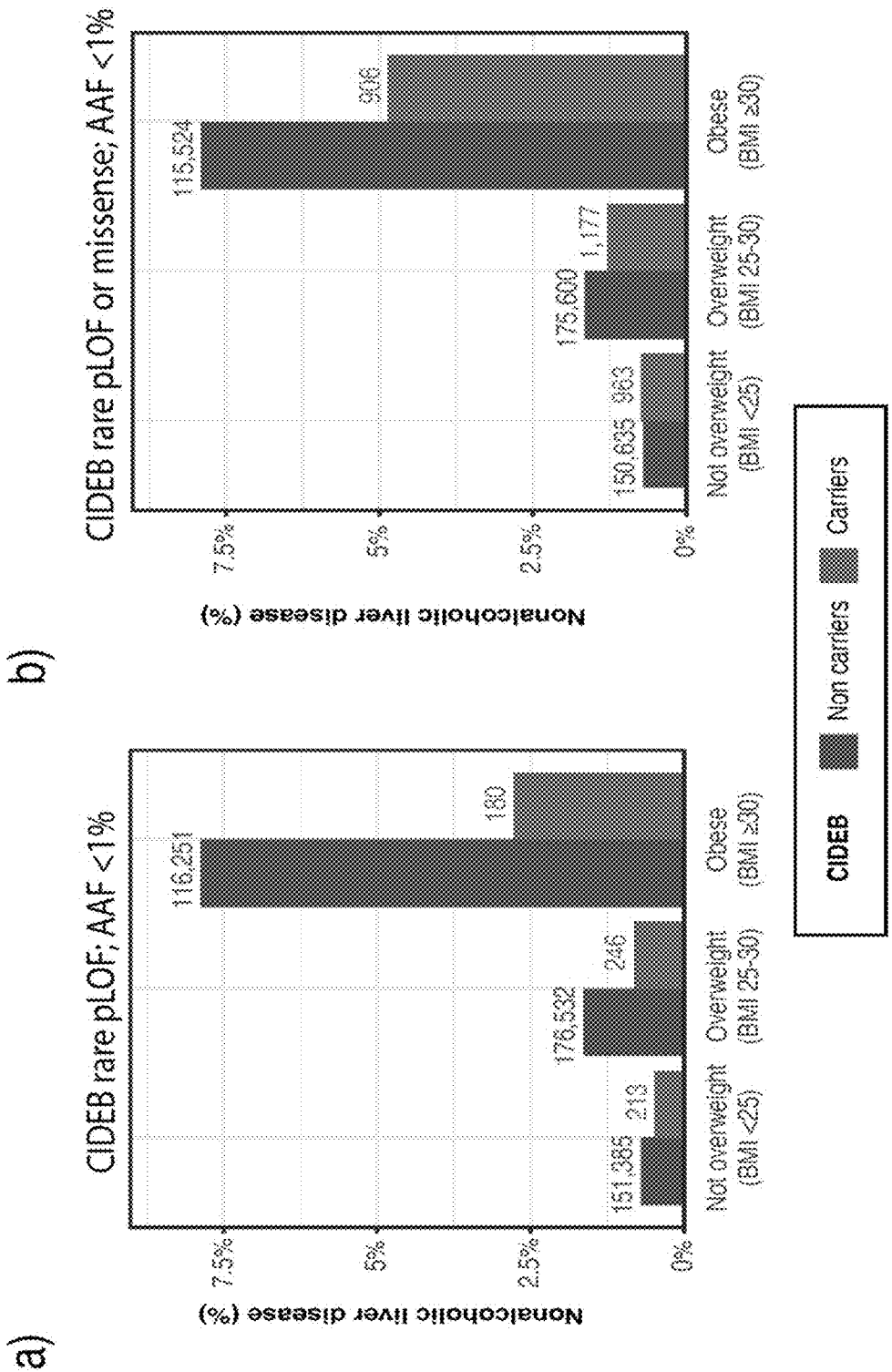
FIG. 6 shows a proportion of nonalcoholic liver disease in carriers and non-carriers of CIDEB rare coding variants across body mass index categories. The percentage of nonalcoholic liver disease is shown for carriers vs non-carriers of rare coding CIDEB variants, stratified by body mass index. Panel a shows carriers of only pLOF variants, and Panel b shows carriers of pLOF and missense variants. Abbreviations: BMI, body mass index; pLOF, predicted loss of function; AAF, alternate allele frequency. Numbers above each bar represents the observed sample size within the group being represented by the bar.

The proportion of liver disease by CIDEB genotypes and BMI categories were also estimated and it was found that the difference in proportion of liver disease in CIDEB rare coding variant carriers versus non-carriers was highest in the obesity category (FIG. 6).

Example 4: Rare Coding Variants in CIDEB Interact with PNPLA3 Genotypes and Show Additive Associations with HSD17B13 Genotypes A common missense variant in the Patatin Like Phospholipase Domain Containing 3 (PNPLA3) gene, encoding a p.Ile148Met (dbSNP rsID, r5738409; C>G substitution) missense change in the PNPLA3 protein is one of the most common and strongest genetic risk factors for liver damage (measured by ALT levels), alcoholic and non-alcoholic liver disease and cirrhosis (Nat. Genet., 2008, 40, 1461-5; and Nat. Genet., 2010, 42, 21-3). In the exome-sequencing dataset, the 148Met risk allele was strongly associated with higher ALT levels (per allele beta in SD units of ALT, 0.11; 95% confidence interval, 0.10, 0.11; $p<1.0\times10^{-300}$) consistent with previous literature.

Figure 7:
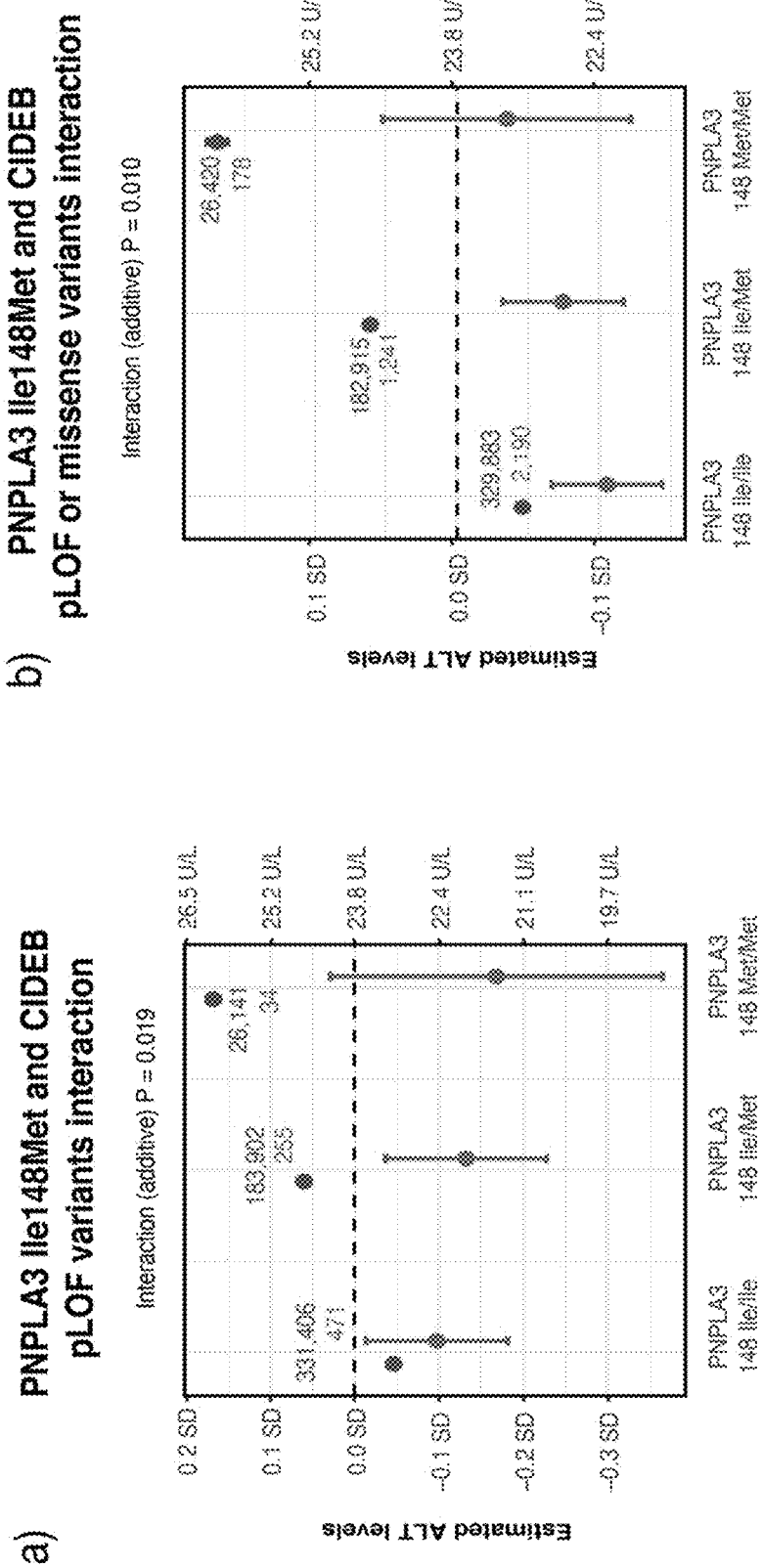
FIG. 7 shows a visualization of the interaction between rare coding variants in CIDEB with PNPLA3 Ile148Met. Panel a shows the interaction of CIDEB genotype (i.e., rare pLOF variants) and Ile148Met on alanine aminotransferase level. Panel b shows the interaction of CIDEB genotype (i.e., rare pLOF and missense variants) and Ile148Met on alanine aminotransferase level. Abbreviations: pLOF, predicted loss of function; SD, standard deviation; P, p-value; ALT, alanine aminotransferase; BMI, body mass index; U/L, units per liter.

A statistically significant interaction was observed between rare coding variants in CIDEB and the common PNPLA3 148Met risk allele on ALT (Table 26 and FIG. 7).

RR indicates the number of individuals carrying no rare missense or pLOF variants in CIDEB (homozygous non-carriers); RA indicates the number of individuals carrying rare missense or pLOF variants in a single CIDEB allele (heterozygous carriers); AA indicates the number of individuals carrying rare missense or pLOF variants in both CIDEB alleles (homozygous carriers); SD indicates standard deviation units; AAF indicates the alternative allele frequency; pLOF indicates predicted loss of function; CI indicates confidence interval.

The first section of Table 26 describes the burden of pLOF or missense variants in CIDEB with AAF<1% as the genetic exposure; second section describes the burden of only pLOF variants in CIDEB with AAF<1% as the genetic exposure. Table 26 shows the association with ALT levels of CIDEB genotype within PNPLA3 rs738409 Ile148Met genotype categories in a meta-analysis of the GHS and UKB cohorts and the estimates from the linear interaction analysis.

The association with lower ALT levels for rare pLOF variants in CIDEB was strongest in homozygous carriers of the 148Met risk allele (G/G group), with an estimated effect size that was 5 times larger in a protective direction than what was observed in homozygous carriers of the PNPLA3 148 Ile allele (C/C group; Table 26). Therefore, the protective association against liver damage observed in carriers of rare pLOF or missense variants in CIDEB is greater in individuals carrying the common PNPLA3 148Met risk allele.

No significant interactions were found between rare coding variants in CIDEB and the splice variant rs72613567 which causes loss of function in HSDB17B13 and has been shown to protect against liver disease (N. Engl. J. Med., 2018, 378, 1096-106) (Table 27). These results indicate that rare coding variants in CIDEB have additive protective associations to those of rs72613567-TA in HSD17B13.

TABLE 26

Interaction between rare pLOF or missense variants in CIDEB and PNPLA3 Ile148Met on ALT levels

| PNPLA3 rs738409 (Ile148Met) genotype group, CIDEB genotype exposure | Per allele beta (95% CI) in SD units of ALT levels | p-value | Genotype counts, RR\|RA\|AA genotypes | Interaction beta (95% CI) in SD units of ALT per each additional CIDEB allele and PNPLA3 148Met allele | p-value for linear interaction between CIDEB genotype and PNPLA3 genotype |
|---|---|---|---|---|---|
| C/C (p.148 Ile/Ile), CIDEB pLOF plus any missense | −0.06 (−0.10, −0.02) | 1.8E−03 | 329883\|2190\|0 | −0.07 (−0.12, −0.02) | 0.010 |
| C/G (p.148 Ile/Met), CIDEB pLOF plus any missense | −0.14 (−0.19, −0.09) | 4.7E−07 | 182915\|1241\|1 | | |
| G/G (p.148 Met/Met), CIDEB pLOF plus any missense | −0.18 (−0.34, −0.03) | 1.8E−02 | 26420\|178\|2 | | |
| C/C (p.148 Ile/Ile), CIDEB pLOF | −0.04 (−0.13, 0.04) | 3.3E−01 | 331406\|471\|0 | −0.14 (−0.26, −0.02) | 0.019 |
| C/G (p.148 Ile/Met), CIDEB pLOF | −0.24 (−0.36, −0.12) | 1.1E−04 | 183902\|255\|0 | | |
| G/G (p.148 Met/Met), CIDEB pLOF | −0.20 (−0.55, 0.16) | 2.8E−01 | 26141\|34\|0 | | |

TABLE 27

Interaction between rare pLOF or missense variants in CIDEB
(AAF <1%) and rs72613567 (HSD17B13 splice variant) on ALT levels

| rs72613567-TA (splice LOF variant in HSD17B13) | Per allele beta (95% CI) in SD units of ALT levels | p-value | Genotype counts, RR\|RA\|AA genotypes | p-value for linear interaction between CIDEB genotype and rs72613567 |
|---|---|---|---|---|
| T/T | −1.2 (−1.9, −0.6) | 2E−04 | 271776\|1629\|1 | 0.88 |
| T/TA | −1.7 (−2.5, −1.0) | 3E−06 | 204162\|1231\|0 | |
| TA/TA | −0.4 (−2.2, 1.3) | 6.4E−01 | 38700\|208\|0 | |

Figure 8:
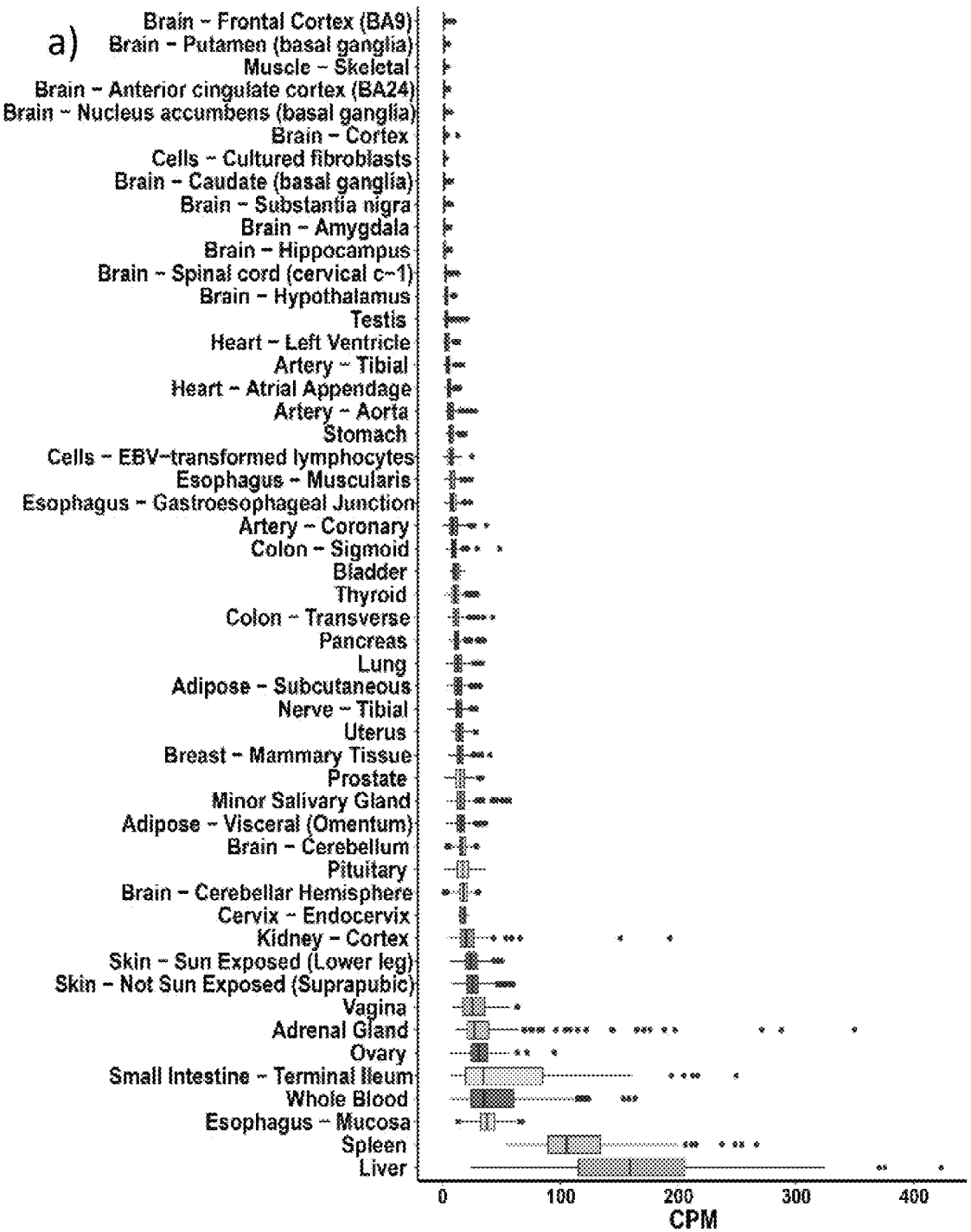
FIG. 8 shows CIDEB expression patterns across tissues (Panel a) and liver cell-types (Panel b). Panel a shows, per tissue, the normalized mRNA expression values for CIDEB in counts per million (CPM) for each individual using data from genotype tissue expression (GTEx) consortium (GTEx Portal 2021. Accessed 2021, June 1st via the world wide web at gtexportal.org/). Panel b shows normalized cell-type specific expression levels within liver, in transcripts per million protein coding genes (pTPM), obtained from the human protein atlas (HPA) (Nat. Biotechnol., 2010, 28, 1248-50). Box plots depict the median (thick black vertical bar), the interquartile range, and minimum and maximum CPM values across individuals per tissue.
Figure 8:
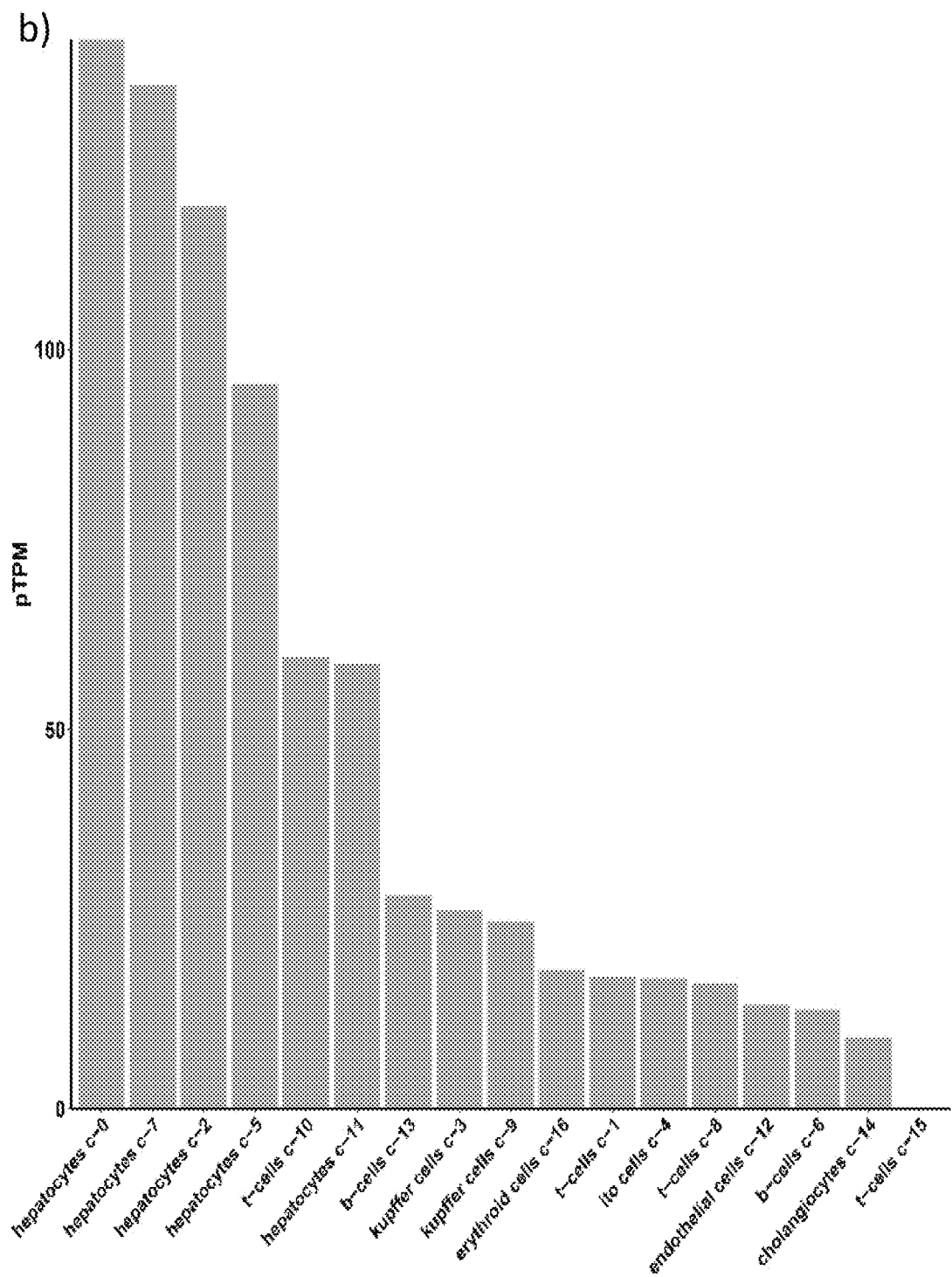

Example 5: CIDEB is Expressed in Hepatocytes at the Surface of Lipid Droplets, Predicted-Loss-of-Function Variants in CIDEB are Associated with Lower Gene Expression in Liver, and Inhibition of CIDEB Expression Via siRNA Decreases Lipid Droplet Size and Reduces Lipid Accumulation in HepG2 Cells The mRNA expression of CIDEB was examined across tissues in humans from the Genotype Tissue Expression consortium (GTEx) and it was found that CIDEB is most highly expressed in liver among the GTEx tissues (FIG. 8). The mRNA expression of CIDEB was also examined among cell types in data from the Human Protein Atlas (HPA) and found that CIDEB is most highly expressed in hepatocytes (FIG. 8).

Figure 9:
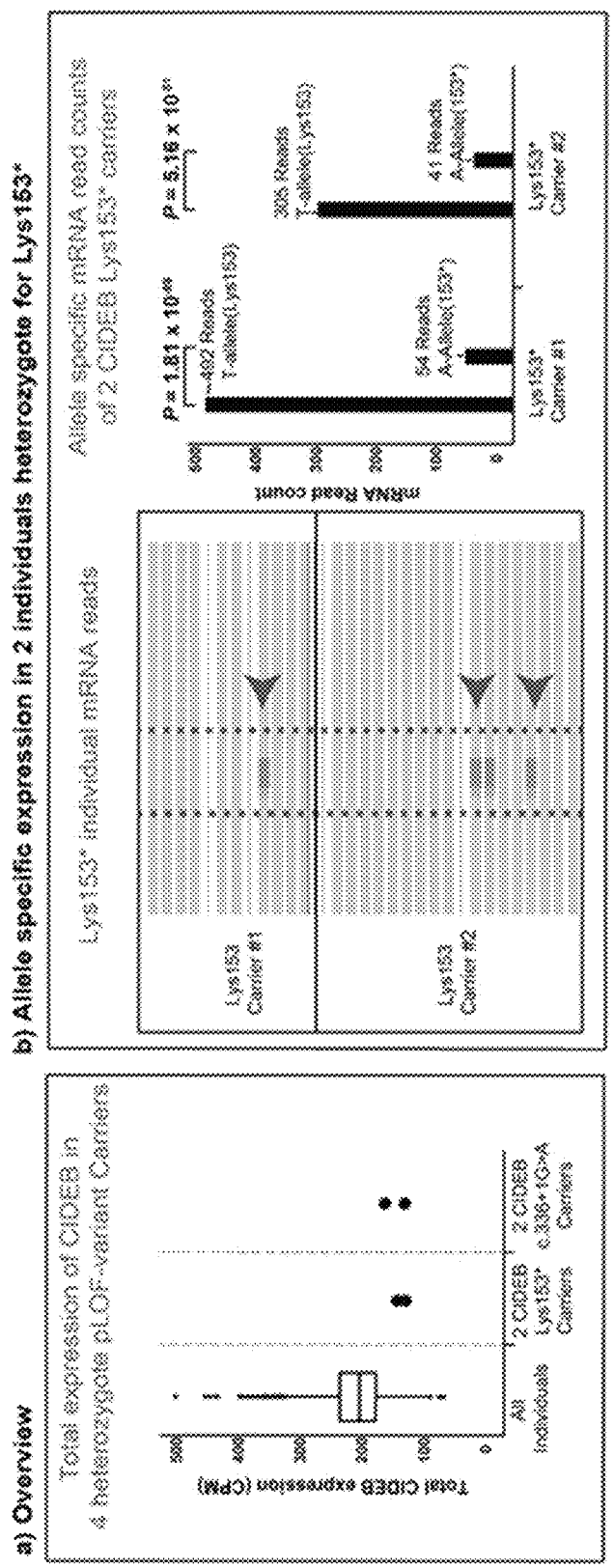
FIG. 9 shows rare pLOF variants in CIDEB impart a loss-of-function via defective mRNA processing in the liver. Panel a shows the level of mRNA expression of CIDEB in liver of bariatric surgery patients from GHS (left), that of two Lys153* heterozygous carriers (middle) and that of two c.336+1G>A heterozygous carriers (right). Panel b shows allele-specific expression results for the two Lys153* heterozygous carriers in RNA sequence reads mapped to the variant site (left; dashed red lines indicate variant site and arrows indicate rare instances where the reads carry the mutant allele) and in a comparison of read counts with or without the mutant allele (right). Panel c shows allele-specific expression results for the two c.336+1G>A heterozygous carriers. The left panel shows RNA sequence reads mapped to the variant site (dashed red lines indicate variant site and arrows indicate rare instances where the reads carry the mutant allele). The middle panel shows the number of spliced and unspliced reads in the two carriers, with unspliced reads being the less frequent occurrence. The right panel shows the allele-specific expression in unspliced reads, which disproportionally carried the variant allele. Abbreviations: pLOF, predicted loss of function; CPM, counts per million; P, p-value; mRNA, mature messenger RNA.
Figure 9:
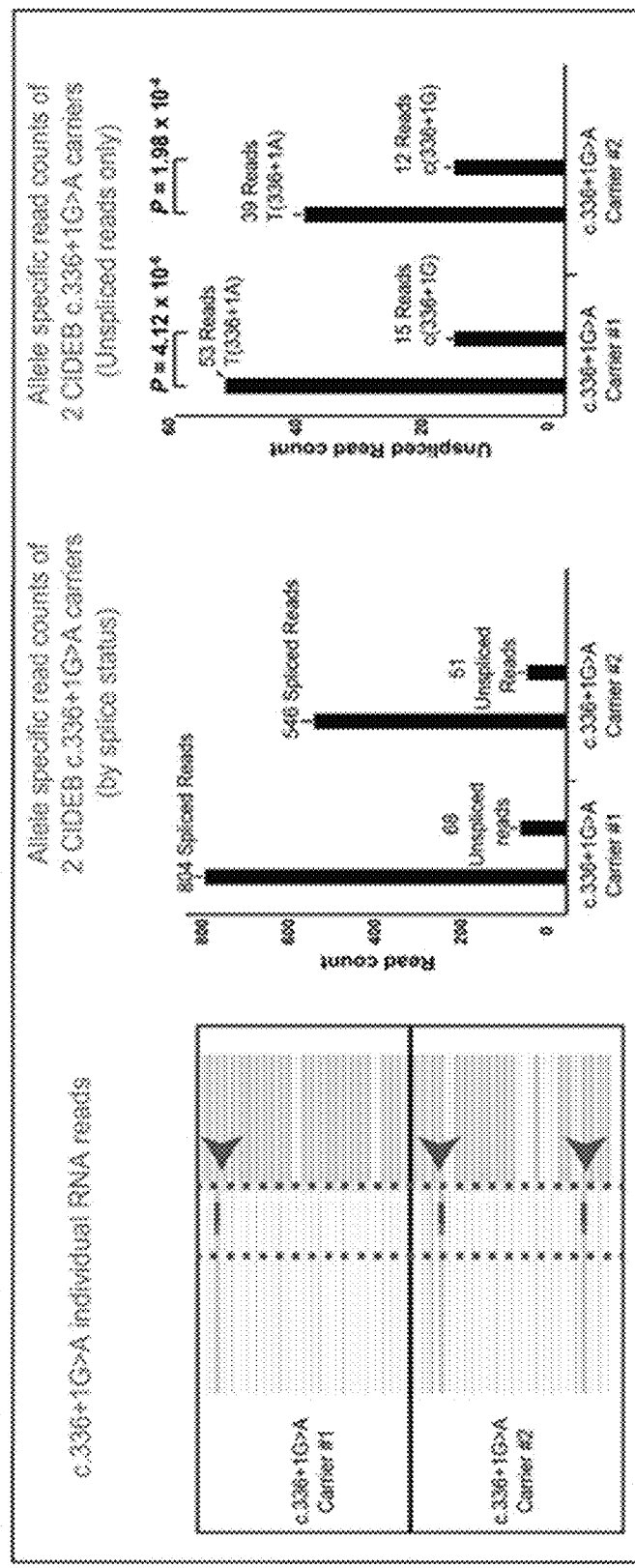

Given that CIDEB is expressed in liver, the impact of predicted loss-of-function (pLOF) variants in the gene was investigated using liver RNASeq data from bariatric surgery patients from GHS. Using liver RNASeq, the impact of two pLOF variants (c.336+1G>A, and Lys153*) was evaluated. These were the only two pLOF variants present in the 2,304 bariatric surgery patients in GHS who underwent RNASeq. Two heterozygous carriers for each of the two variant sites were found and expression levels for CIDEB below the 25th percentile in each of the four carriers were observed (FIG. 9). Both carriers of the Lys153* variant expressed reads containing the stop-gained mutation much less frequently than those carrying the reference allele (expected proportion under the assumption of no impact, 50%; Carrier 1 proportion, 9.9%; $p_{binomial}$ for the observed imbalance=$1.8 \times 10^{-89}$; Carrier 2 proportion, 11.9%; $p_{binomial}=5.2 \times 10^{-51}$; FIG. 9), indicating that the variant is subject to nonsense mediated decay and results in loss of a copy of CIDEB. In carriers of the c.336+1G>A variant, none of the RNASeq reads with spliced sequences that overlap the variant position carried the splice-donor allele. However, RNAseq reads whose unspliced sequences overlapped the position of the splice site were enriched for the splice-donor variant compared to the reference allele (expected proportion under the assumption of no impact, 50%; Carrier 3 proportion, 78.0%; $p_{binomial}=4.1 \times 10^{-06}$; Carrier 4 proportion, 76.5%; $p_{binomial}=2.0 \times 10^{-04}$; FIG. 9), indicating that the variant results in intron retention.

Figure 10:
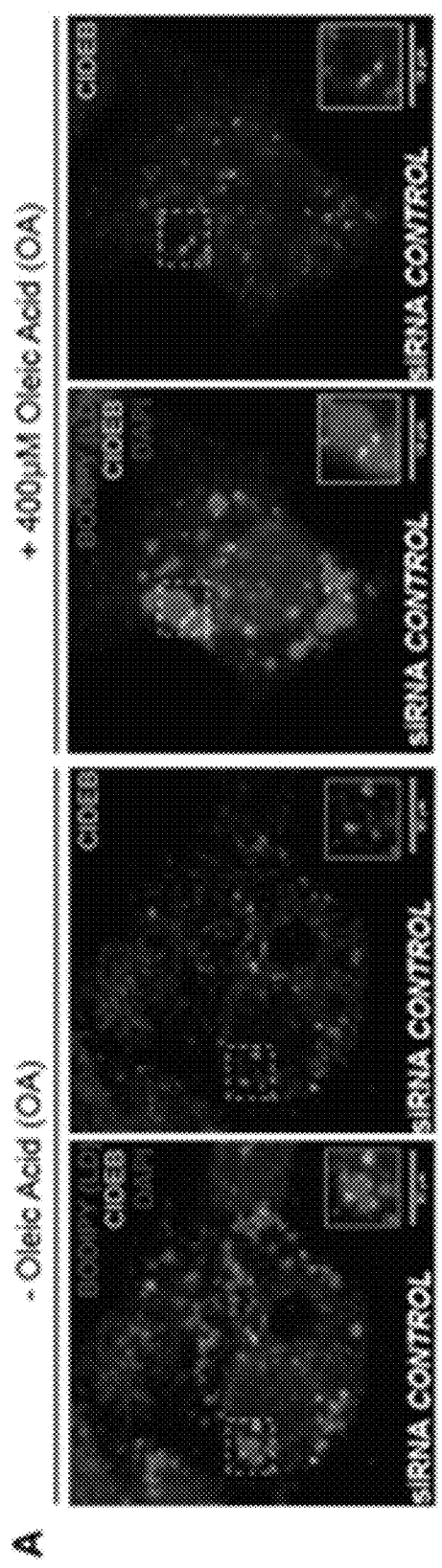
FIG. 10 shows siRNA-mediated knockdown of CIDEB prevents lipid droplet build-up in HepG2 cells. Panel A shows intracellular localization of endogenous CIDEB to the interface of lipid droplets via immunofluorescent staining under basal conditions (no oleic acid) or in the presence of 400 μM oleic acid. Panel B shows the CIDEB protein staining is detectable in cells treated with control siRNA (top) but not CIDEB siRNA (bottom), demonstrating specificity of the CIDEB antibody used in both basal conditions (left) and oleic acid treatment (right). Purple, antibody staining of CIDEB; green, neutral lipids stained by BODIPY; blue, nuclei stained by DAPI; scale bar, 10 μm. Panel C shows western blot analysis (left and center) of CIDEB protein expression and Taqman analysis of CIDEB mRNA expression (right) in control or CIDEB siRNA-treated HepG2 cells. Data are presented as mean±s.d of independent wells and Welch's t-test was performed to determine statistical significance where * represents p<0.05. Panel D shows representative images of oleic acid treatment and CIDEB siRNA impact on lipid droplet size and distribution. Red, neutral lipids stained by AdipoRed; blue, nuclei stained by DAPI; scale bar, 20 μm. Panels E, F, and H show quantification of imaging-derived lipid droplet characteristics, barplots show mean±s.d. of 4 independent wells, depicted as individual points, per condition. Panel E shows the average number of lipid droplets per cell; Panel F shows the average lipid droplet size (quantified from the three-dimensional volume of individual lipid droplets); Panel H shows the average cell lipid droplet staining (quantified as the total area of lipid droplet staining in each cell). Panel G shows average triglyceride concentration per cell quantified using an enzymatic assay; data are mean±s.d of nine independent wells, depicted as individual points, per condition. Panel I shows concentrated of proinflammatory cytokine IL-8 secreted into the cell media quantified by immunoassay; data are mean±s.d. Differences in E-I were assessed using a two-way ANOVA; Tukey's multiple comparisons tests with Sidak correction were used to assess pairwise comparisons of CIDEB siRNA or oleic acid treatment (ns, not significant; * p<0.05;  p<0.01; * p<0.001; **** p<0.0001). Panel J shows AdipoRed staining of neutral lipids demonstrating increasing concentrations of oleic acid result in a dose-dependent increase lipid droplet size and cell lipid droplet staining (left). CIDEB siRNA pretreatment reduces the size of lipid droplets relative to control siRNA pretreatment (right). Red, neutral lipids stained by AdipoRed; blue, nuclei stained by 4',6-diamidino-2-phenylindole (DAPI); scale bar, 20 μm. Abbreviations: DAPI, 4',6-diamidino-2-phenylindole; OA, oleic acid; LD, lipid droplet.
Figure 10:
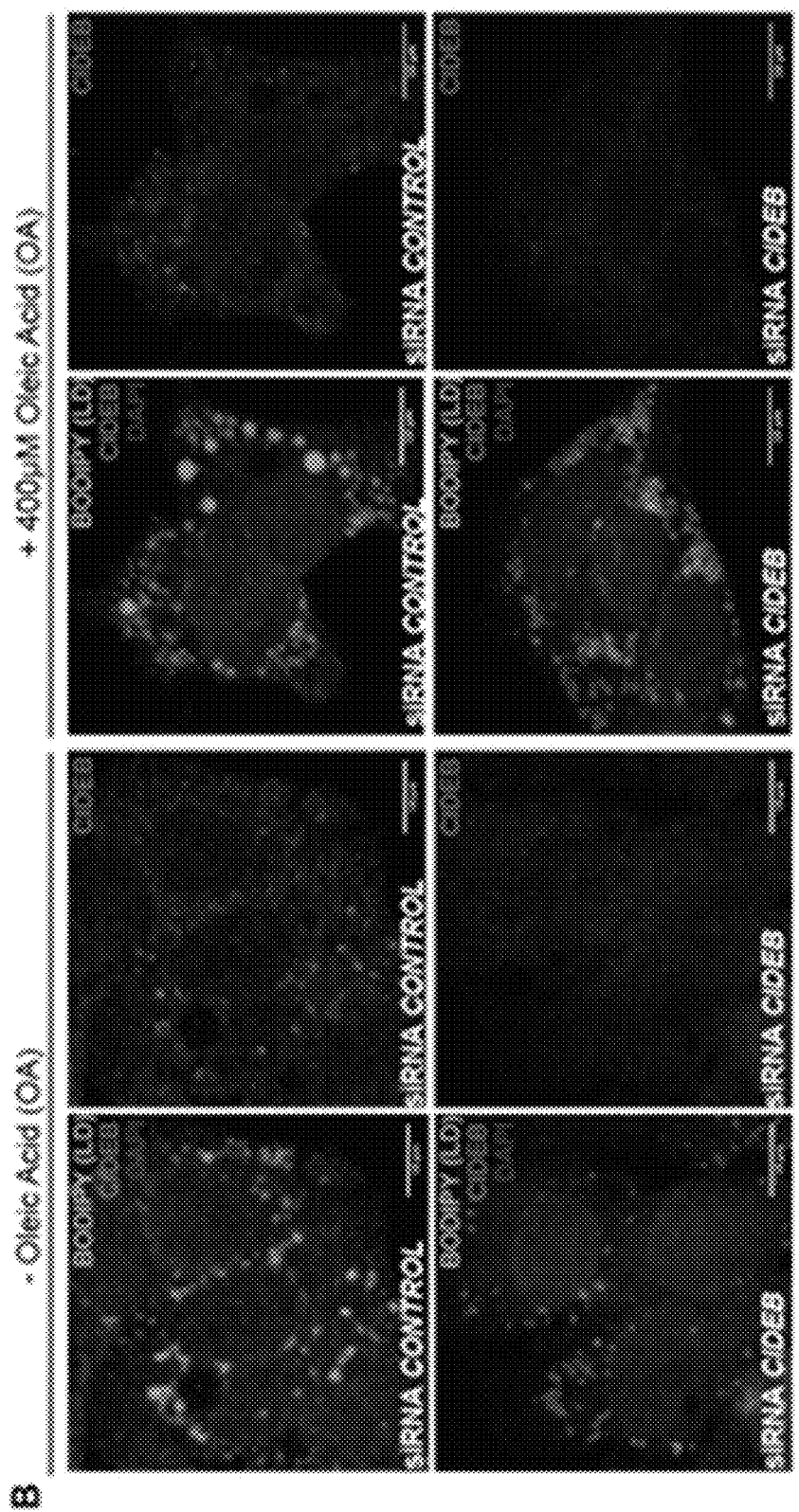
Figure 10:
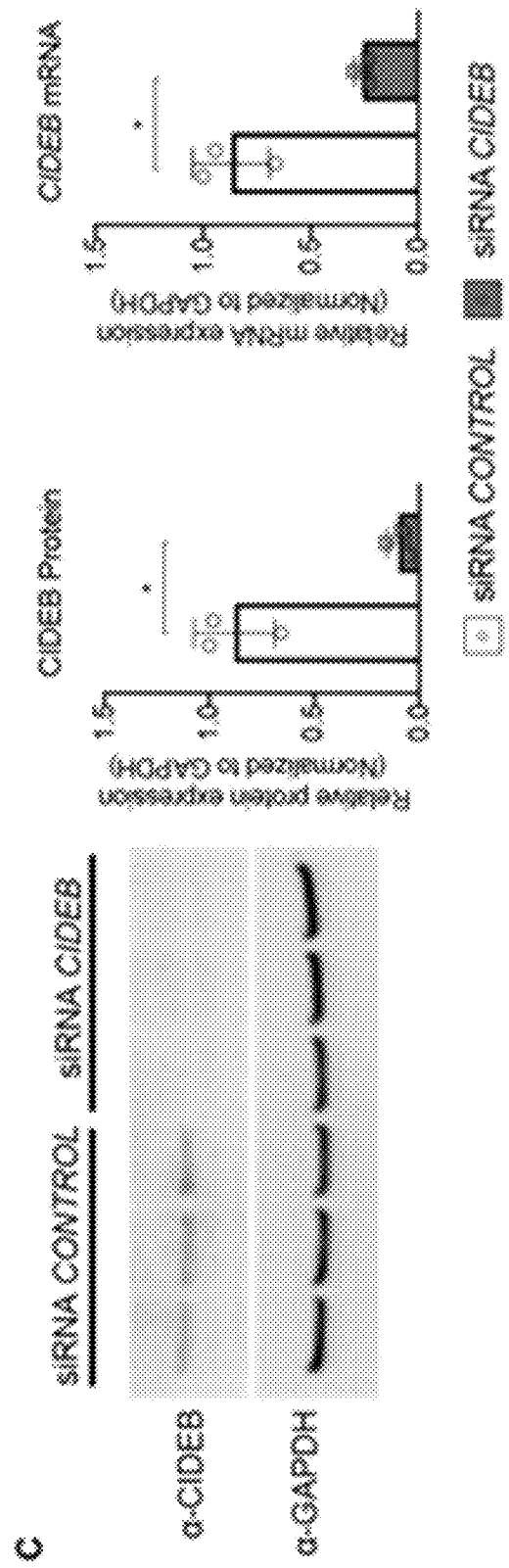
Figure 10:
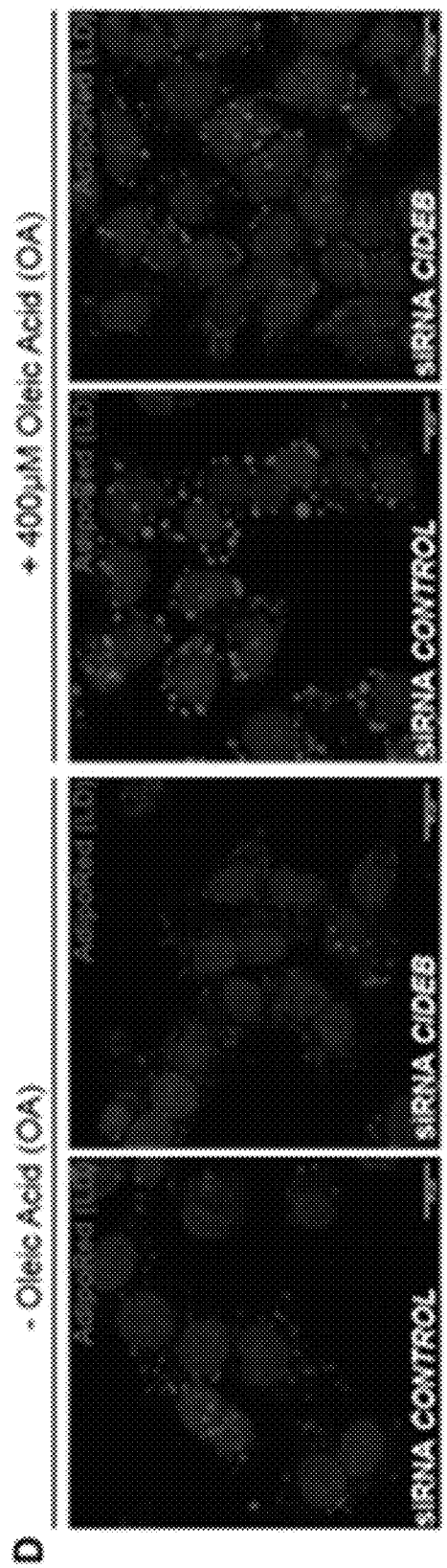
Figure 10:
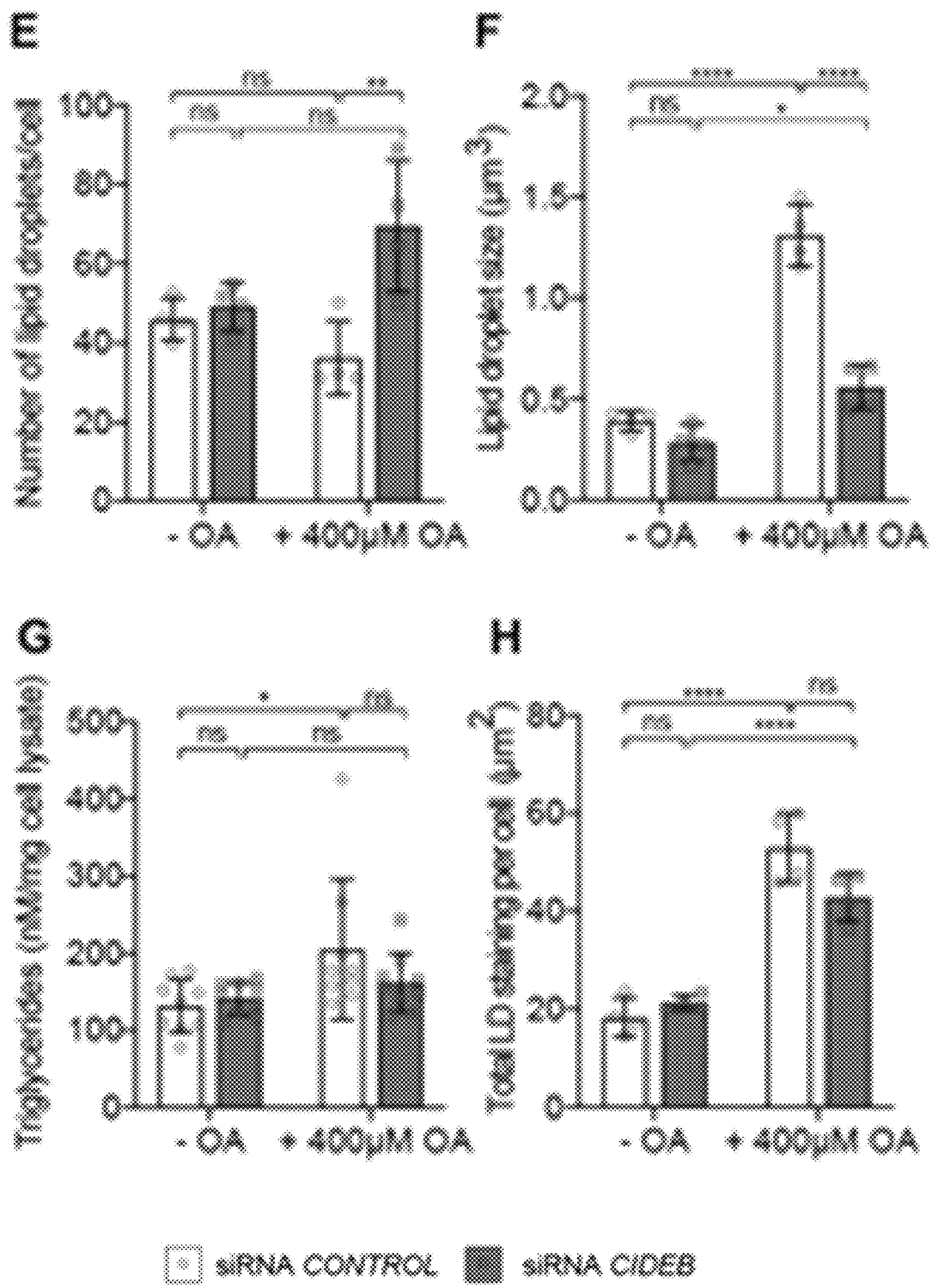
Figure 10:
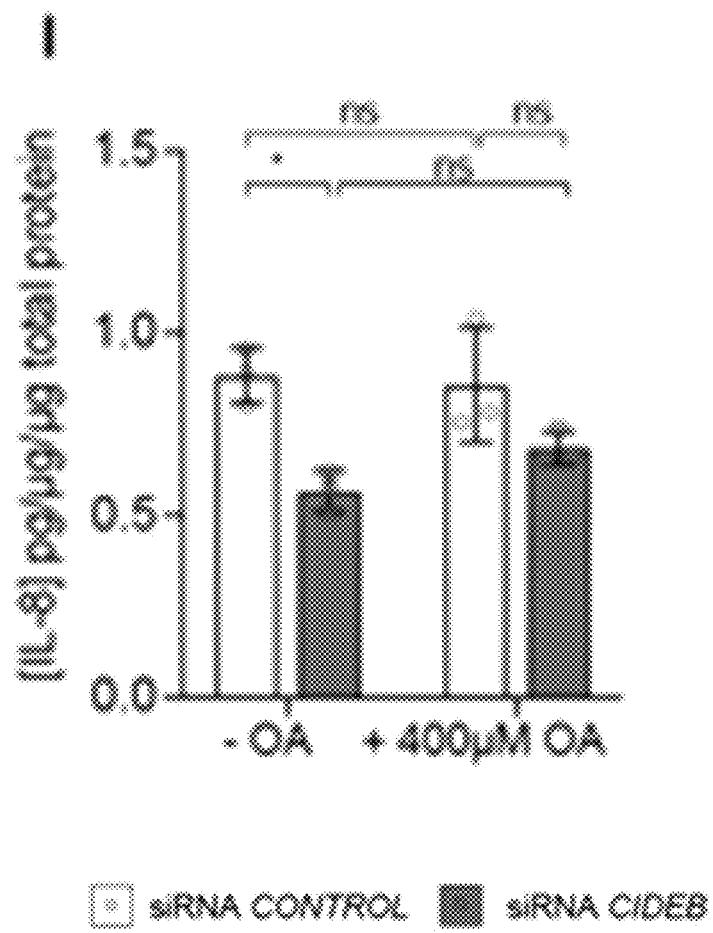
Figure 10:
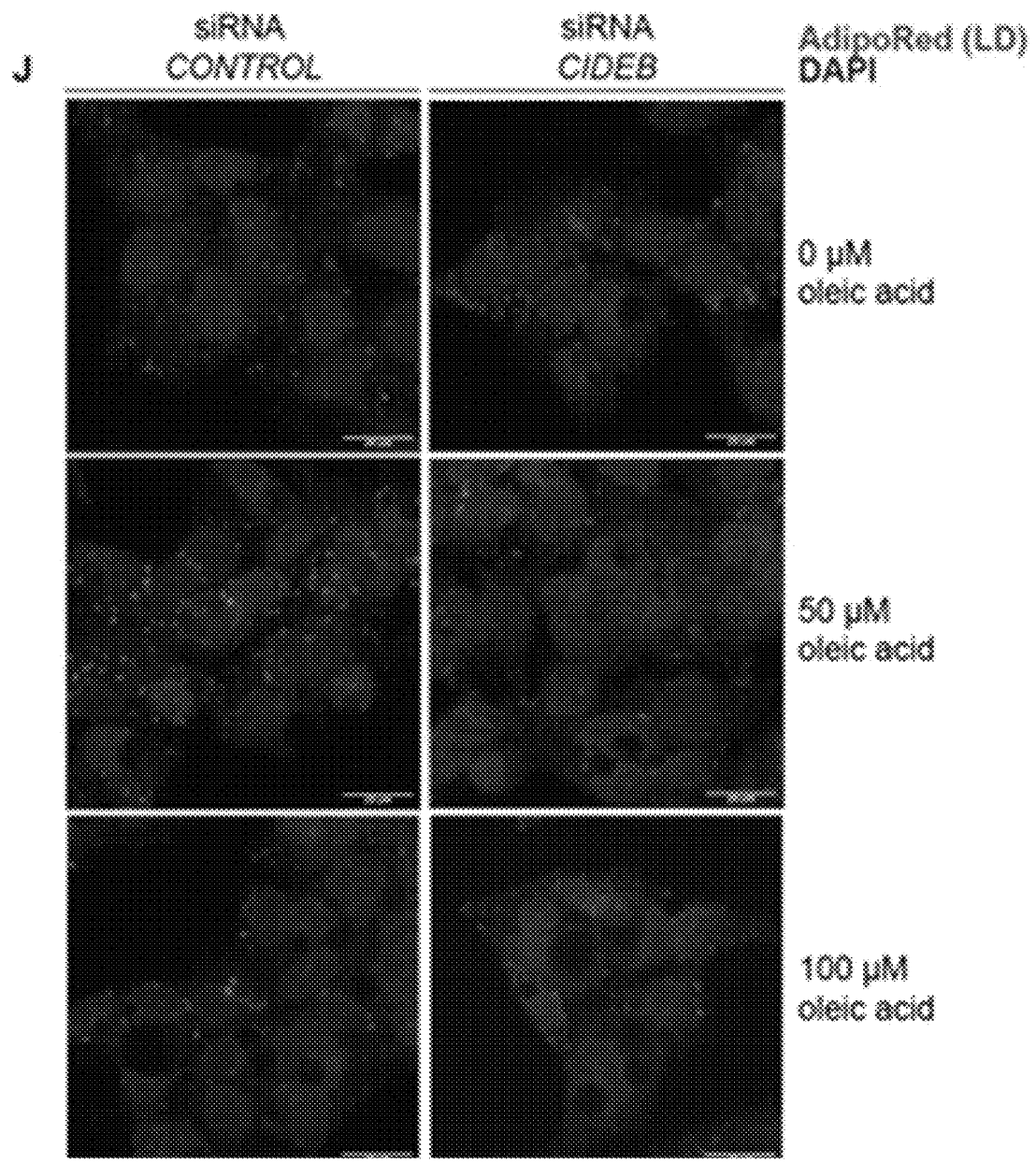
Figure 10:
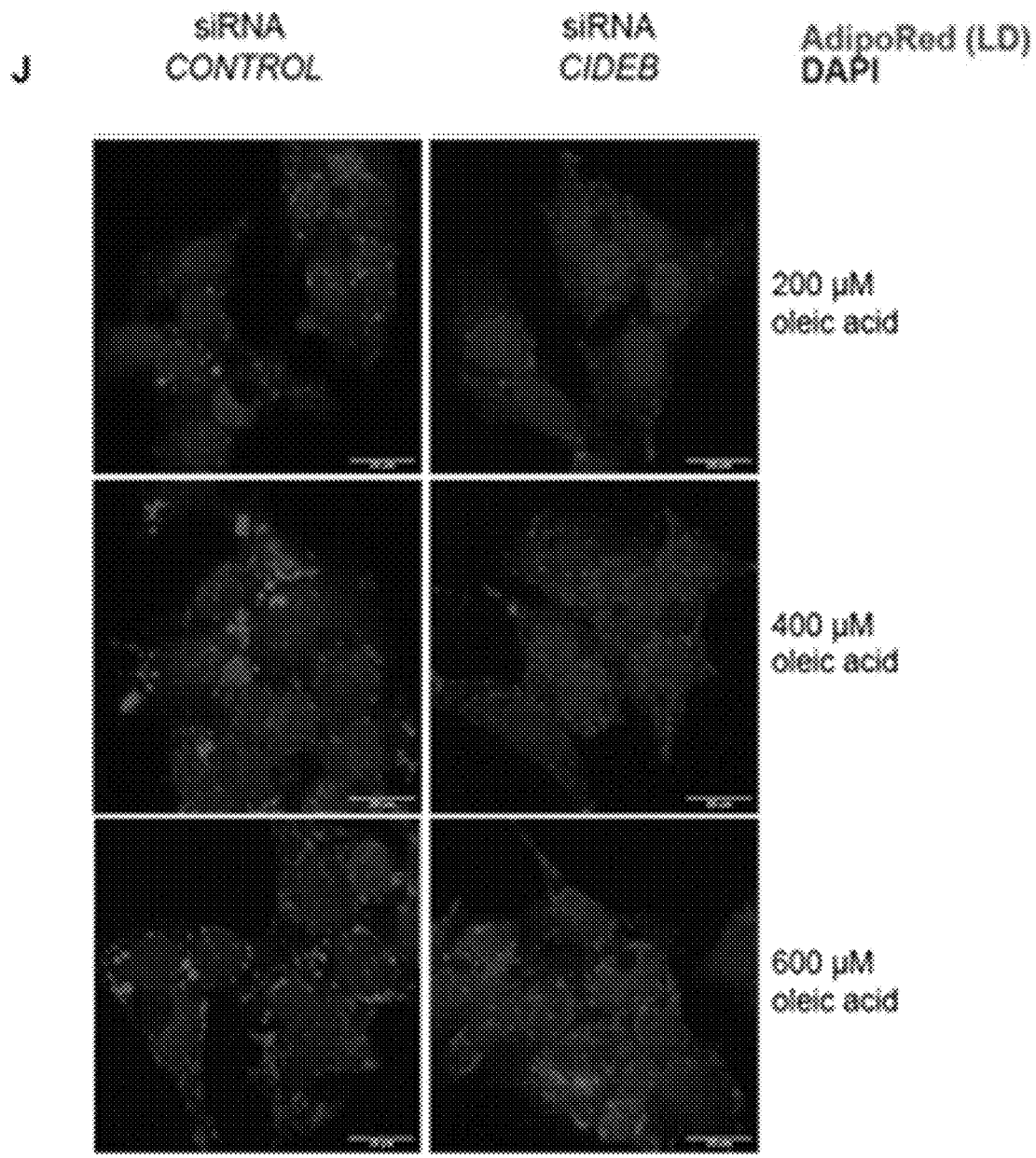

Given that the protective loss-of-function variants in CIDEB were associated with lower liver expression of this gene, the effects of siRNA-mediated knockdown of CIDEB were studied in human hepatocellular carcinoma HepG2 cells with and without treatment with oleic acid, a monosaturated omega-9 fatty acid that is routinely used to mimic steatosis conditions in vitro. In particular, HepG2 human hepatoma cells were treated with control siRNA or siRNA targeting CIDEB. 24 hours after siRNA transfection, cells were treated with 0 µM or 400 µM oleic acid for 24 hours. Endogenous CIDEB protein localized to punctae on the surfaces of lipid droplets and at the interfaces of adjacent lipid droplets in both conditions in cells treated with a non-targeting pool of control siRNA (FIG. 10, Panel A); no CIDEB staining was observed in cells treated with CIDEB siRNA to inhibit CIDEB expression (FIG. 10, Panel B), demonstrating the specificity of the CIDEB antibody used. For each treatment, the left-side image shows the merge of all three stains and the right-side image shows staining of CIDEB only. Further quantification showed that the CIDEB siRNA inhibited CIDEB mRNA expression by 71% and inhibited CIDEB protein expression by 89% (FIG. 10, Panel C). GAPDH was used as loading and normalization control.

Silencing of CIDEB did not affect lipid droplet number or average lipid droplet size, cell triglyceride content or cell lipid droplet staining in the basal condition (FIG. 10, Panels D, E, F, G, and H). CIDEB siRNA-treated cells secreted less IL-8 (FIG. 10, Panel I), a proinflammatory cytokine linked to NAFLD progression, consistent with the genetic associations showing decreased risk of inflammatory liver diseases such as NASH and cirrhosis. Cells were next treated with oleic acid to induce fat accumulation. Oleic acid resulted in the appearance of larger lipid droplets in cells treated with control siRNA in a manner proportional to the amount of oleic acid administered (FIG. 10, Panel J), with increased average lipid droplet size, cell triglyceride content and cell lipid droplet staining (FIG. 10, Panels E, F, G, and H). Numerical, non statistically-significant reductions in average cell triglyceride content or cell lipid droplet staining were observed in CIDEB siRNA-treated cells (FIG. 10, Panels G and H), in line with the genetic association results for liver fat fraction. However, inhibition of CIDEB expression prior to oleic acid treatment resulted in an increased number of smaller lipid droplets compared to cells treated with control siRNA, with significantly reduced average lipid droplet size (p<0.0001) and increased number of lipid droplets per cell (p<0.01) (FIG. 10, Panels D, E, and F).

Various modifications of the described subject matter, in addition to those described herein, will be apparent to those skilled in the art from the foregoing description. Such modifications are also intended to fall within the scope of the appended claims. Each reference (including, but not limited to, journal articles, U.S. and non-U.S. patents, patent application publications, international patent application publications, gene bank accession numbers, and the like) cited in the present application is incorporated herein by reference in its entirety.

SEQUENCE LISTING (10045 sequences)

SEQ ID NO: 1 - DNA, 6236 bp, Homo sapiens
gccagcgctgcgaccgcctgcagaaggttgactgcgtggtagggggcccagagcaagccgaaggcaagcacgatggcgctcaccagccggcccacccgcgccccgtgccgcccggagccccagcgggcgccccgcagccgtgccagcgtcacgctgtagcagccgagcatcagcccgaaaggaagcacgaaagcggtcagagtctccaggctcaggtgggcggcggcgtggaccggcgacgggtggcacagctggcatacgcggtccctccacaggtggcggtagacggcggccgggacggcgagcaacagggcggccagccagaccgccagcagcaggcggcgggccagggccgggctgcgcagccgaggcgccaggaaggggcgggtgactgcgaggcagcgctgcaggctgagcaggccggtgagcagcacgctggcgtacatgctgagcgcgcacacgtagtacaccgccttgcagcccgcctggcccagcggccaggcctgccgggtcaggaaggccacaaagagcggcgtgagcagcagcaccgcgccgtcggccagcgccaggtgcagcacaagcgtggccgccagcggtcgcccccgtgcaggccgccagcccgccaagctccacaccacgaagccgttgccaggcagccccagcagcgccgccagcagcaggaaggctgtgcctgtggcccgcgaagtcttccagctcagcagtgtctcgttccctgggggacggtagcagaccgacatccttctgggcctacaggtgggtggaaggcgccacagagggcgttcaggggtggggcaaaaccccacctgtgatgcccgatgagaaggtgccatgcctcctccttacttccctgcagcctgcctcttttctgcctgggagtcctgacttccacgaggacccagaccccacctcaaacacaactccttcttggaacccagatcccctgctcccagtcagttgacctgccccactcctggcctccttcccagagctcagtggtaaacaggcataaagtcatcaccccaggctgtcactatctctaccaccactcctctagtctggcccctccttctttgtccagccccattctagcacatctgggcaaaactggatggtggggtgtaaagggacgtgcacagatctacttaccaagctgggagcaagcaggattgggggcctggagaagctgaaaggttaagcagcagtaggcgaggtgcctactcctgtcctgtgcctatcacatttgcagagggtaagacaagaatggggagggacaagatgaggctcatcctgggcctctcctggggcccctccctcaccctgctccttcccatcaccaacgcacccaggcgtccaggcatgtgagagcctgccttgccaggaaacagcacaagctgaagtggggcagtaagattccctggtggtggaaggaaataggaggactctgctgaatcctggtcctgcttctgttctcatccctcccccagctctggccccaatcctcccagcccaccttctgcagtgtgtatgttgcctggtctctctggcctgcagaggtgacccaaacaactcagtcccccacctgccttatccttgcctgtttccagtctcctggtccggctgagcccctggcctcctacctcctcccacctcttgcctcaggccctgccccagtcactccaccctcagggctctcaccgggctgtcaatgacagcttttccatgtaaggcatggtgctaggttccaggaggaacaggggatgcatggaggcataatggttagggagtcatgacacacaaccatgaagaggccccattaccaggctgcaccaggatacaagacaagaaaggaaaggatgagtagggacatactaagaagcagccctctcctcttggaaaagtcaagcaaaacttggaaatgaagagatttgaggggggcctggcagatggatagagctgggggaagggaaaagaaaggcctctgctcaagtaacagccagaacttgaggttgcttggggagggcaccaggagcactgtcttagtttgggttcttccaaagcagagcttgagctaagggcttgggtacaggtgatcctgtattcttgagctaagggcttgggtacaggtgatcctgtatttgggaggttaactcaggaagtgagggcataaggtaaaacaagagagaggaaagccattaagagtatgttaagtcccttcagtaggccttgggaacctctgagaaaagtatagattgcccaagacaaaagactggcagggtgatcagtccaaagcatttattaggagaatgtacttaatgagtgggctacagcgtatcctcacaacagacagtgagagagagttgttctacctgggtatatccaaaacaagggggtcagggtatggagtttacgagggttcaaggtatttggttcagggccagggccagtttttttcagtgttttgggcaacaacctgaataccttttcaaggctctggcttgggctcaagcctgcaggggaaatgcaactggccaggtcacagggcaatcaagttactctgtgtttctttgtcaggacacagaaaaaaagtggggaagctgggggaccctacaaggatccttggcaggaaagcagggattgtgttcatttgagggtttcactgtcagtgagagtctcagcttccatgcaactgtccatcacggctgcaactgaaatcagagctgggacacagcgcaccagaagctaaagtcttgatgccatcaaaggacatccctgccccattcacatctctgtcacgtccactaatcggcaaaaggagaaaagtgagagaagatgacctaagtgtgactgcagcaggcagctctggaaaatgaagccagagcagtgagccagcccctcctccgaccaaggaggaaggaaagagcaggtaagcaggaaggccagtgtcccagacaggaccctaatgatcctgaatccatgtatcaggatccatcctctccttacacccttcctggacacagtctcacctctcattttccaaagccctgccatgctgccatcccacttccccacactctgccccgggttcccttttcctaaagctgcagcttatggcttctccagtaggtggcagcacacacagagccactcataaactgcagcttctcagagcctgagagccagaaaccgtccccagaaattccctccatagaaataaaaaaacaccagaagtcacatttcatccttttacatggttcccatctaccctcacaacacatgtcatcaccaaagacacacatacaagctccaatggcttttgccaggcaattcttcctccaggaccccatctggcccctccctcatccctccccttggactttgcccttcttactggccaggcaggggggccagagtccaggcttgactcattcccaccttgtcctgggctgagatcccaggtttgtaacagaaaacaccactaaagccccagcacaggagagaaccacccagcccagaagttccagggaaggaactctccggtccaccatggagtacctctcagctctgaaccccagtgacttactcaggtgactgctaaccctccgctctaccctccacctttaggggatataggcagggcaacaatactccactcagcccctaggagactaaccagtaccccttcctctcctgctccccactccacagtgggcttgtcaagctcctgagccacccgcccccacctgcactccatggtctctccctcatccctaatcgataaacctagatctctccctccctagccctctagccactctaccctcatcatgccctttacactcaccaagcccctcctcgccccttcttgacttttcttctcaactaccaggtcagtatctaatataagctcggagtttggacggagggtctggacctcagctccaccaccccagcgacctttccgtgtctgtgatcacaagcggaccatccggaaaggcctgacagctgccacccgccaggagctgctagccaaagtaagtaggccaagttcctcggttcctatagcaggggtagccaaggggctccacaacagtggcaacttgtgatgatggagcagagggctgaagtcacacagctgcccctccctctgagggctaaaagcagcggagtgggcctaatgagctctggtcaatttgttcattttccaccgagtgagcttttctatgggagcaggggttagcaggagatagggagagttcgagggacagaattcagaagctagtatggaaaggtgatttgtgtgacaaatcaagttcaaattctgattctgccacttcctgcctgtcaaaccttgggaagttgttcaacctaccaaaacctcagtttcttcaactataaaaaggcaataataatacatcacctcctagggttgttgaaaggagtaagaggataatgtaggtaaagtcctcatacctggcacagagtaaggactcaaaaaggttaaacactattactgaaaacacttctggagaactcttgagggtgtgggaagtgaggtgcagcattgtagataagacagaagggtggacttcgtgagaacctggcttgctttccaattccaaaccagaagtgacttggaggggagcaaggggagatgccaatgacatggtaggagcaaagaggaaaaaggtcagcctctagctaggatcccccaaaaactgaagaacacggagagctgcaacctttaggaggtatcaaagtgccggaaagtcaaagtgggacatcgaccaatgtctagagccaactgatggatgttgggcagctaaagagggaaggggcatgggataagacctgcccttcttgcttcttgccattgggcaggcattggagaccctactgctgaatggagtgctaaccctggtgctagaggaggatggaactgcagtggacagtgaggacttcttccagctgctggaggatgacacgtgcctgatggtgttgcagtctggtcagagctggagccctacaagggtaagaggcctatactggggctgcttccaatgcctgtcctttagagctttcccgggcttcctctctagcttaaccctgatcctggggaccaggtgcaggaggagttgtggaattgtcaaggatgtcacacagtggacagaaagtccaagcgagggagggtctgacccagtgctgatggagattagtggtgggtgtctggtatgaggatctactgcactgacaagggtgtcctacagagtggagtgctgtcatatggcctgggacgggagaggcccaagcacagcaaggacatcgcccgattcacctttgacgtgtacaagcaaaaccctcgagacctctttggcagcctgaatgtcaaagccacattctacgggctctactctatgagttgtgactttcaaggacttggcccaaagaaagtactcaggtcagaaatcaacatgtcatactgccccatcccctacagttggatagtccccataattcgtcctcttgcacccacctacccctagttagctcttgcttgtggaaagtcctcatctcccagcttgatggcttcctcccaagttttccaaatcatctgatttcctcttgtctctgccattcagggagctccttcgttggacctccacactgctgcaaggcctgggccatatgttgctgggaatttcctccacccttcgtcatgcagtggagggggctgagcagtggcagcagaagggccgcctccattcctactaaggggctctgagcttctgcccccagaatcattccaaccgacccactgcaaagactatgacagcatcaaatttcaggacctgcagacagtacaggctagataacccacccaatttccccactgtcctctgatcccctcgtgacagaacctttcagcataacgcctcacatcccaagtctatacccttacctgaagaatgctgttctttcctagccacctttctggcctcccacttgccctgaaaggccaagatcaagatgtcccccaggcatcttgatcccagcctgactgctgctacatctaatcccctaccaatgcctcctgtccctaaactccccagcatactgatgacagccctctctgactttaccttgagatctgtcttcatacccttcccctcaaactaacaaaaacatttccaataaaaatatcaaatatttaccactaa

SEQ ID NO: 2 - RNA, 1602 nt, Homo sapiens
gagccacucauaaacugcagcuucucagagccugagagccagaaaccguccccagaaauucccuccauagaaauaaaaaaacaccagaagucacauuucauccuuuuacaugguucccaucuacccucacaacacaugucaucaccaaagacacacauacaagcuccaauggcuuuugccaggcaauucuuccuccaggaccccaucuggccccucccucaucccuccccuuggacuuugcccuucuuacuggccaggcaggggggccagaguccaggcuugacucauucccaccuuguccugggcugagaucccagguuuguaacagaaaacaccacuaaagccccagcacaggagagaaccacccagcccagaaguuccagggaaggaacucuccgguccaccauggaguaccucucagcucugaaccccagugacuuacucaggucaguaucuaauauaagcucggaguuuggacggagggucuggaccucagcuccaccaccccagcgaccuuuccgugucugugaucacaagcggaccauccggaaaggccugacagcugccacccgccaggagcugcuagccaaagcauuggagacccuacugcugaauggagugcuaacccuggugcuagaggaggauggaacugcaguggacagugaggacuucuuccagcugcuggaggaugacacgugccugaugguguugcagucuggucagagcuggagcccuacaaggaguggagugcugucauauggccugggacgggagaggcccaagcacagcaaggacaucgcccgauucaccuuugacguguacaagcaaaacccucgagaccucuuuggcagccugaaugucaaagccacauucuacgggcucuacucuaugaguugugacuuucaaggacuuggcccaaagaaaguacucagggagcuccuucguuggaccuccacacugcugcaaggccugggccauauguugcugggaauuuccuccacccuucgucaugcaguggagggggcugagcaguggcagcagaagggccgccuccauuccuacuaaggggcucugagcuucugcccccagaaucauuccaaccgacccacugcaaagacuaugacagcaucaaauuucaggaccugcagacaguacaggcuagauaacccacccaauuuccccacuguccucugauccccucgugacagaaccuuucagcauaacgccucacaucccaagucuauacccuuaccugaagaaugcuguucuuuccuagccaccuuucuggccucccacuugcccugaaaggccaagaucaagaugucccccaggcaucuugaucccagccugacugcugcuacaucuaauccccuaccaaugccuccugucccuaaacuccccagcauacugaugacagcccucucugacuuuaccuugagaucugucuucauacccuuccccucaaacuaacaaaaacauuuccaauaaaaauaucaaauauuuaccacuaagacuucugacuccaauuuaaaccaggaaagggaugggguggauaccccauuuugcccucccccaucaacacccagucccagauccaaagcc

SEQ ID NO: 3 - RNA, 2294 nt, Homo sapiens
gccagcgcugcgaccgccugcagaagguugacugcgugguagggggcccagagcaagccgaaggcaagcacgauggcgcucaccagccggcccacccgcgccccgugccgcccggagccccagcgggcgccccgcagccgugccagcgucacgcuguagcagccgagcaucagcccgaaaggaagcacgaaagcggucagagucuccaggcucaggugggcggcggcguggaccggcgacggguggcacagcuggcauacgcggucccuccacagguggcgguagacggcggccgggacggcgagcaacagggcggccagccagaccgccagcagcaggcggcgggccagggccgggcugcgcagccgaggcgccaggaaggggcgggugacugcgaggcagcgcugcaggcugagcaggccggugagcagcacgcuggcguacaugcugagcgcgcacacguaguacaccgccuugcagcccgccuggcccagcggccaggccugccgggucaggaaggccacaaagagcggcgugagcagcagcaccgcgccgucggccagcgccaggugcagcacaagcguggccgccagcggucgcccccgugcaggccgccagcccgccaagcuccacaccacgaagccguugccaggcagccccagcagcgccgccagcagcaggaaggcugugccuguggcccgcgaagucuuccagcucagcagugucucguucccugggggacgguagcagaccgacauccuucugggccuacaggacacagaaaaaaaguggggaagcugggggacccuacaaggauccuuggcaggaaagcagggauuguguucauuugaggguuucacugucagugagagucucagcuuccaugcaacuguccaucacggcugcaacugaaaucagagcugggacacagcgcaccagaagcuaaagucuugaugccaucaaaggacaucccugccccauucacaucucugucacguccacuaaucggcaaaaggagaaaagugagagaagaugaccuaagugugacugcagcaggcagcucuggaaaaugaagccagagcagugagccagccccuccuccgaccaaggaggaaggaaagagcagccccagcacaggagagaaccacccagcccagaaguuccagggaaggaacucuccgguccaccauggaguaccucucagcucugaaccccagugacuuacucaggucaguaucuaauauaagcucggaguuuggacggagggucuggaccucagcuccaccaccccagcgaccuuuccgugucugugaucacaagcggaccauccggaaaggccugacagcugccacccgccaggagcugcuagccaaagcauuggagacccuacugcugaauggagugcuaacccuggugcuagaggaggauggaacugcaguggacagugaggacuucuuccagcugcuggaggaugacacgugccugaugguguugcagucuggucagagcuggagcccuacaaggaguggagugcugucauauggccugggacgggagaggcccaagcacagcaaggacaucgcccgauucaccuuugacguguacaagcaaaacccucgagaccucuuuggcagccugaaugucaaagccacauucuacgggcucuacucuaugaguugugacuuucaaggacuuggcccaaagaaaguacucagggagcuccuucguuggaccuccacacugcugcaaggccugggccauauguugcugggaauuuccuccacccuucgucaugcaguggagggggcugagcaguggcagcagaagggccgccuccauuccuacuaaggggcucugagcuucugcccccagaaucauuccaaccgacccacugcaaagacuaugacagcaucaaauuucaggaccugcagacaguacaggcuagauaacccacccaauuuccccacuguccucugauccccucgugacagaaccuuucagcauaacgccucacaucccaagucuauacccuuaccugaagaaugcuguucuuuccuagccaccuuucuggccucccacuugcccugaaaggccaagaucaagaugucccccaggcaucuugaucccagccugacugcugcuacaucuaauccccuaccaaugccuccugucccuaaacuccccagcauacugaugacagcccucucugacuuuaccuugagaucugucuucauacccuuccccucaaacuaacaaaaacauuuccaauaaaaauaucaaauauuuaccacuaa

SEQ ID NO: 4 - RNA, 2409 nt, Homo sapiens
uugacugcgugguagggggcccagagcaagccgaaggcaagcacgauggcgcucaccagccggcccacccgcgccccgugccgcccggagccccagcgggcgccccgcagccgugccagcgucacgcuguagcagccgagcaucagcccgaaaggaagcacgaaagcggucagagucuccaggcucaggugggcggcggcguggaccggcgacggguggcacagcuggcauacgcggucccuccacagguggcgguagacggcggccgggacggcgagcaacagggcggccagccagaccgccagcagcaggcggcgggccagggccgggcugcgcagccgaggcgccaggaaggggcgggugacugcgaggcagcgcugcaggcugagcaggccggugagcagcacgcuggcguacaugcugagcgcgcacacguaguacaccgccuugcagcccgccuggcccagcggccaggccugccgggucaggaaggccacaaagagcggcgugagcagcagcaccgcgccgucggccagcgccaggugcagcacaagcguggccgccagcggucgcccccgugcaggccgccagcccgccaagcuccacaccacgaagccguugccaggcagccccagcagcgccgccagcagcaggaaggcugugccuguggcccgcgaagucuuccagcucagcagugucucguucccugggggacgguagcagaccgacauccuucugggccuacagccugccucuuuucugccugggaguccugacuuccacgaggacccagaccccaccucaaacacaacuccuucuuggaacccagauccccugcucccagucaguugaccugccccacuccuggccuccuucccagagcucaguggacacagaaaaaaaguggggaagcugggggacccuacaaggauccuuggcaggaaagcagggauuguguucauuugaggguuucacugucagugagagucucagcuuccaugcaacuguccaucacggcugcaacugaaaucagagcugggacacagcgcaccagaagcuaaagucuugaugccaucaaaggacaucccugccccauucacaucucugucacguccacuaaucggcaaaaggagaaaagugagagaagaugaccuaagugugacugcagcaggcagcucuggaaaaugaagccagagcagugagccagccccuccuccgaccaaggaggaaggaaagagcagccccagcacaggagagaaccacccagcccagaaguuccagggaaggaacucuccgguccaccauggaguaccucucagcucugaaccccagugacuuacucaggucaguaucuaauauaagcucggaguuuggacggagggucuggaccucagcuccaccaccccagcgaccuuuccgugucugugaucacaagcggaccauccggaaaggccugacagcugccacccgccaggagcugcuagccaaagcauuggagacccuacugcugaauggagugcuaacccuggugcuagaggaggauggaacugcaguggacagugaggacuucuuccagcugcuggaggaugacacgugccugaugguguugcagucuggucagagcuggagcccuacaaggaguggagugcugucauauggccugggacgggagaggcccaagcacagcaaggacaucgcccgauucaccuuugacguguacaagcaaaacccucgagaccucuuuggcagccugaaugucaaagccacauucuacgggcucuacucuaugaguugugacuuucaaggacuuggcccaaagaaaguacucagggagcuccuucguuggaccuccacacugcugcaaggccugggccauauguugcugggaauuuccuccacccuucgucaugcaguggagggggcugagcaguggcagcagaagggccgccuccauuccuacuaaggggcucugagcuucugcccccagaaucauuccaaccgacccacugcaaagacuaugacagcaucaaauuucaggaccugcagacaguacaggcuagauaacccacccaauuuccccacuguccucugauccccucgugacagaaccuuucagcauaacgccucacaucccaagucuauacccuuaccugaagaaugcuguucuuuccuagccaccuuucuggccucccacuugcccugaaaggccaagaucaagaugucccccaggcaucuugaucccagccugacugcugcuacaucuaauccccuaccaaugccuccugucccuaaacuccccagcauacugaugacagcccucucugacuuuaccuugagaucugucuucauacccuuccccucaaacuaacaaaaacauuuccaauaaaaauaucaaauauuuaccacuaa

SEQ ID NO: 5 - RNA, 2540 nt, Homo sapiens
cccuuccgguggagccagcgcugcgaccgccugcagaagguugacugcgugguagggggcccagagcaagccgaaggcaagcacgauggcgcucaccagccggcccacccgcgccccgugccgcccggagccccagcgggcgccccgcagccgugccagcgucacgcuguagcagccgagcaucagcccgaaaggaagcacgaaagcggucagagucuccaggcucaggugggcggcggcguggaccggcgacggguggcacagcuggcauacgcggucccuccacagguggcgguagacggcggccgggacggcgagcaacagggcggccagccagaccgccagcagcaggcggcgggccagggccgggcugcgcagccgaggcgccaggaaggggcgggugacugcgaggcagcgcugcaggcugagcaggccggugagcagcacgcuggcguacaugcugagcgcgcacacguaguacaccgccuugcagcccgccuggcccagcggccaggccugccgggucaggaaggccacaaagagcggcgugagcagcagcaccgcgccgucggccagcgccaggugcagcacaagcguggccgccagcggucgcccccgugcaggccgccagcccgccaagcuccacaccacgaagccguugccaggcagccccagcagcgccgccagcagcaggaaggcugugccuguggcccgcgaagucuuccagcucagcagugucucguucccugggggacgguagcagaccgacauccuucugggccuacagccugccucuuuucugccugggaguccugacuuccacgaggacccagaccccaccucaaacacaacuccuucuuggaacccagauccccugcucccagucaguugaccugccccacuccuggccuccuucccagagcucaguggacacagaaaaaaaguggggaagcugggggacccuacaaggauccuuggcaggaaagcagggauuguguucauuugaggguuucacugucagugagagucucagcuuccaugcaacuguccaucacggcugcaacugaaaucagagcugggacacagcgcaccagaagcuaaagucuugaugccaucaaaggacaucccugccccauucacaucucugucacguccacuaaucggcaaaaggagaaaagugagagaagaugaccuaagugugacugcagcaggcagcucuggaaaaugaagccagagcagugagccagccccuccuccgaccaaggaggaaggaaagagcagccccagcacaggagagaaccacccagcccagaaguuccagggaaggaacucuccgguccaccauggaguaccucucagcucugaaccccagugacuuacucaggucaguaucuaauauaagcucggaguuuggacggagggucuggaccucagcuccaccaccccagcgaccuuuccgugucugugaucacaagcggaccauccggaaaggccugacagcugccacccgccaggagcugcuagccaaagcauuggagacccuacugcugaauggagugcuaacccuggugcuagaggaggauggaacugcaguggacagugaggacuucuuccagcugcuggaggaugacacgugccugaugguguugcagucuggucagagcuggagcccuacaaggaguggagugcugucauauggccugggacgggagaggcccaagcacagcaaggacaucgcccgauucaccuuugacguguacaagcaaaacccucgagaccucuuuggcagccugaaugucaaagccacauucuacgggcucuacucuaugaguugugacuuucaaggacuuggcccaaagaaaguacucagggagcuccuucguuggaccuccacacugcugcaaggccugggccauauguugcugggaauuuccuccacccuucgucaugcaguggagggggcugagcaguggcagcagaagggccgccuccauuccuacuaaggggcucugagcuucugcccccagaaucauuccaaccgacccacugcaaagacuaugacagcaucaaauuucaggaccugcagacaguacaggcuagauaacccacccaauuuccccacuguccucugauccccucgugacagaaccuuucagcauaacgccucacaucccaagucuauacccuuaccugaagaaugcuguucuuuccuagccaccuuucuggccucccacuugcccugaaaggccaagaucaagaugucccccaggcaucuugaucccagccugacugcugcuacaucuaauccccuaccaaugccuccugucccuaaacuccccagcauacugaugacagcccucucugacuuuaccuugagaucugucuucauacccuuccccucaaacuaacaaaaacauuuccaauaaaaauaucaaauauuuaccacuaagacuucugacuccaauuuaaaccaggaaagggaugggguggauaccccauuuugcccucccccaucaacacccagucccagauccaaagcc

SEQ ID NO: 6 - RNA, 2540 nt, Homo sapiens; identical to SEQ ID NO: 5

SEQ ID NO: 7 - RNA, 1511 nt, Homo sapiens
cacauuucauccuuuuacaugguucccaucuacccucacaacacaugucaucaccaaagacacacauacaagcuccaauggcuuuugccaggcaauucuuccuccaggaccccaucuggccccucccucaucccuccccuuggacuuugcccuucuuacuggccaggcaggggggccagaguccaggcuugacucauucccaccuuguccugggcugagaucccagguuuguaacagaaaacaccacuaaagccccagcacaggagagaaccacccagcccagaaguuccagggaaggaacucuccgguccaccauggaguaccucucagcucugaaccccagugacuuacucaggucaguaucuaauauaagcucggaguuuggacggagggucuggaccucagcuccaccaccccagcgaccuuuccgugucugugaucacaagcggaccauccggaaaggccugacagcugccacccgccaggagcugcuagccaaagcauuggagacccuacugcugaauggagugcuaacccuggugcuagaggaggauggaacugcaguggacagugaggacuucuuccagcugcuggaggaugacacgugccugaugguguugcagucuggucagagcuggagcccuacaaggaguggagugcugucauauggccugggacgggagaggcccaagcacagcaaggacaucgcccgauucaccuuugacguguacaagcaaaacccucgagaccucuuuggcagccugaaugucaaagccacauucuacgggcucuacucuaugaguugugacuuucaaggacuuggcccaaagaaaguacucagggagcuccuucguuggaccuccacacugcugcaaggccugggccauauguugcugggaauuuccuccacccuucgucaugcaguggagggggcugagcaguggcagcagaagggccgccuccauuccuacuaaggggcucugagcuucugcccccagaaucauuccaaccgacccacugcaaagacuaugacagcaucaaauuucaggaccugcagacaguacaggcuagauaacccacccaauuuccccacuguccucugauccccucgugacagaaccuuucagcauaacgccucacaucccaagucuauacccuuaccugaagaaugcuguucuuuccuagccaccuuucuggccucccacuugcccugaaaggccaagaucaagaugucccccaggcaucuugaucccagccugacugcugcuacaucuaauccccuaccaaugccuccugucccuaaacuccccagcauacugaugacagcccucucugacuuuaccuugagaucugucuucauacccuuccccucaaacuaacaaaaacauuuccaauaaaaauaucaaauauuuaccacuaagacuucugacuccaauuuaaaccaggaaagggaugggguggauaccccauuuugcccucccccaucaacacccagucccagauccaaagcc

SEQ ID NO: 8 - RNA, 1329 nt, Homo sapiens
agaucccagguuuguaacagaaaacaccacuaaagccccagcacaggagagaaccacccagcccagaaguuccagggaaggaacucuccgguccaccauggaguaccucucagcucugaaccccagugacuuacucaggucaguaucuaauauaagcucggaguuuggacggagggucuggaccucagcuccaccaccccagcgaccuuuccgugucugugaucacaagcggaccauccggaaaggccugacagcugccacccgccaggagcugcuagccaaagcauuggagacccuacugcugaauggagugcuaacccuggugcuagaggaggauggaacugcaguggacagugaggacuucuuccagcugcuggaggaugacacgugccugaugguguugcagucuggucagagcuggagcccuacaaggaguggagugcugucauauggccugggacgggagaggcccaagcacagcaaggacaucgcccgauucaccuuugacguguacaagcaaaacccucgagaccucuuuggcagccugaaugucaaagccacauucuacgggcucuacucuaugaguugugacuuucaaggacuuggcccaaagaaaguacucagggagcuccuucguuggaccuccacacugcugcaaggccugggccauauguugcugggaauuuccuccacccuucgucaugcaguggagggggcugagcaguggcagcagaagggccgccuccauuccuacuaaggggcucugagcuucugcccccagaaucauuccaaccgacccacugcaaagacuaugacagcaucaaauuucaggaccugcagacaguacaggcuagauaacccacccaauuuccccacuguccucugauccccucgugacagaaccuuucaagcauaacgccuacaucccaagucuauacccuuaccugaagaaugcuguucuuuccuagccaccuuucuagccucccacuugcccugaaaggccaagaucaagaugucccccaggcaucuugaucccagccugacugcugcuacaucuaauccccuaccaaugccuccugucccuaaacuccccagcauacugaugacagcccucucugacuuuaccuugagaucugucuucauacccuuccccucaaacuaacaaaaacauuuccaauaaaaauaucaaauauuuaccacuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 9 - RNA, 2289 nt, Homo sapiens
ucgcggccgcgucracgcgugguagggggcccagagcaagccgaaggcaagcacgauggcgcucaccagccggcccacccgcgccccgugccgcccggagccccagcgggcgccccgcagccgugccagcgucacgcuguagcagccgagcaucagccgaaaggaagcacgaaagcggucagagucuccaggcucaggugggcggcggcguggaccggcgacggguggcacagcuggcauacgcggucccuccacagguggcgguagacggcggccgggacggcgagcaacagggcggccagccagaccgccagcagcaggcggcgggccagggccgggcugcgcagccgaggcgccaggaaggggcgggugacugcgaggcagcgcugcaggcugagcaggccggugagcagcacgcuuggcguacaugcugagcgcgcacacguaguacaccgccuugcagcccgccuggcccagcggccaggccugccggucaggaaggccacaaagagcggcgugagcagcagcaccgcgccgucggccagcgccaggugcagcacaagcguggccgccagcggucgcccccgugcaggcugccagcccgccaagcuccacaccacgaagccguugccaggcagccccagcagcgccgccagcagcaggaaggcugugccuguggcccgcgaagucuuccagcucagcagugucucguucccugggggacgguagcagaccgacauccuucugggccuacaggacacagaaaaaaaguggggaagcugggggacccuacaaggauccuuggcaggaaagcagggauuguguucauuuugaggguuucacugucagugagagucucagcuuccaugcaacuguccaucacggcugcaacugaaaucagagcugggacacagcgcaccagaagcuaaagucuugaugccaucaaaggacauccccugccccauucacayauucacaucucugucacguccacuaaucggcaaaaggagaaaagugagagaagaugaccuaagugugacugcagcaggcagcucuggaaaaugaagccagagcagugagccagccccuccuccgaccaaggaggaaggaaagagcagccccagcacaggagagaaccacccagcccagaaguuccagggaaggaacucuccgguccaccauggaguaccucucagcucugaaccccagugacuuacucaggucaguaucuaauauaagcucggaguuuggacggagggucuggaccucagcuccaccaccccagcgaccuuuccgugucugugaucacaagcggaccauccggaaaggccugacagcugccacccgccaggagcugcuagccaaagcauuggagacccuacugcugaauggagugcuaacccuggugcuagaggaggauggaacugcaguggacagugaggacuucuuccagcugcuggaggaugacacgugccugaugguguugcagucuggucagagcuggagcccuacaaggaguggagugcugucauaugggccuggacgggagagccccaagcacagcaaggacaucggccgauucaccuuugacguguacaagcaaaacccucgagaccucuuuggcagccugaaugucaaagccacauucuacgggcucuacucuaugaguugugacuuucaaggacuuggcccaaagaaaguacucagggagcuccuucguuggaccuccacacugcugcaaggccugggccauauguugcugggaauuuccuccacccuucgucaugcaguggagggggcugagcaguggcagcagaagggccgccuccauuccuacuaaggggcucugagcuucugcccccagaaucauuccaaccgacccacugcaaagacuaugacagcaucaaauuucaggaccugcagacaguacaggcuagauaacccacccaauuuccccacuguccucugauccccucgugacagaaccuuucagcauaacgccucacaucccaagucuauacccuuaccugaagaaugcuguucuuuccuagccaccuuucuagccucccacuugcccugaaaggccaagaucaagaugucccccaggcaucuugaucccagccugacugcugcuacaucuaauccccuaccaaugccuccugucccuaaacuccccagcauacugaugacagcccucucugacuuuaccuugagaucugucuucauacccuuccccucaaacuaacaaaaacauuuccaauaaaaauaucaaauauuuaccgucaaccc

SEQ ID NO: 10 - RNA, 1206 nt, Homo sapiens
agguuuguaacaugaaaacaccacuaaagccccagcacaggagagaaccacccagcccagaaguuccagggaaggaacucuccgguccaccauggaguaccucucagcucugaaccccagugacuuacucaggucaguaucuaauauaagcucggaguuuggacggagggucuggaccucagcuccaccaccccagcgaccuuuccgugucugugaucacaagcggaccauccggaaaggccugacagcugccacccgccaggagcugcuagccaaagcauuggagacccuacugcugaauggagugcuaacccuggugcuagaggaggauggaacugcaguggacagugaggacuucuuccagcugcuggaggaugacacgugccugaugguguugcagucuggucagagcuggagcccuacaaggaguggagugcugucauauggccugggacgggagaggcccaagcacagcaaggacaucgcccgauucaccuuugacguguacaagcaaaacccucgagaccucuuuggcagccugaaugucaaagccacauucuacgggcucuacucuaugaguugugacuuucaaggacuuggcccaaagaaaguacucagggagcuccuucguuggaccuccacacugcugcaaggccugggccauauguugcugggaauuuccuccacccuucgucaugcaguggagggggcugagcaguggcagcagaagggccgccuccauuccuacuaaggggcucugagcuucugcccccagaaucauuccaaccgaccacugcaaagacuaugacagcaucaaauuucaggaccugcagacaguacaggcuagauaacccacccaauuuccccacuguccucugauccccucgugacagaaccuuucagcauaacgccucacaucccaagucuauacccuuaccugaagaaugcuguucuuuccuagccaccuuucuggccucccacuugcccugaaaggccaagaucaagaugucccccaggcaucuugaucccagccugacugcugcuacaucuaauccccuaccaaugccuccugucccuaaacuccccagcauacugaugacagcccucucugacuuuaccuugagaucugucuucauacccuuccccucaaacuaacaaaaacauuuccaauaaaaauaucaaauauuuaaaaaaaaaaaaaaaaaa

SEQ ID NO: 11 - RNA, 3826 nt, Homo sapiens
agcuucgccaaggccccuuccgguggagccagcgcugcgaccgccugcagaagguugacugcgugguagggggcccagagcaagccgaaggcaagcacgauggcgcucaccagccggcccacccgcgccccgugccgcccggagccccagcgggcgccccgcagccgugccagcgucacgcuguagcagccgagcaucagcccgaaaggaagcacgaaagcggucagagucuccaggcucaggugggcggcggcguggaccggcgacggguggcacagcuggcauacgcggucccuccacagguggcgguagacggcggccgggacggcgagcaacagggcggccagccagaccgccagcagcaggcggcgggccagggccgggcugcgcagccgaggcgccaggaaggggcgggugacugcgaggcagcgcugcaggcugagcaggccggugagcagcacgcuggcguacaugcugagcgcgcacacguaguacaccgccuugcagcccgccuggcccagcggccaggccugccgggucaggaaggccacaaagagcggcgugagcagcagcaccgcgccgucggccagcgccaggugcagcacaagcguggccgccagcggucgcccccgugcaggccgccagcccgccaagcuccacaccacgaagccguugccaggcagccccagcagcgccgccagcagcaggaaggcugugccuguggcccgcgaagucuuccagcucagcagugucucguucccugggggacgguagcagaccgacauccuucugggccuacagguggguggaaggcgccacagagggcguucagggguggggcaaaaccccaccugugaugcccgaugagaaggugccaugccuccuccuuacuucccugcagccugccucuuuucugccugggaguccugacuuccacgaggacccagaccccaccucaaacacaacuccuucuuggaacccagauccccugcucccagucaguugaccugccccacuccuggccuccuucccagagcucagugguaaacaggcauaaaguccucaccccaggcugucacuaucucuaccaccacuccucuagucuggccccuccuucuuuguccagccccauucuagcacaucugggcaaaacuggauggugggguguaaagggacgugcacagaucuacuuaccaagcugggagcaagcaggauugggggccuggagaagcugaaagguuaagcagcaguaggcgaggugccuacuccuguccugugccuaucacauuugcagaggugacccaaacaacucagucccccaccugccuuauccuugccuguuuccagucuccugguccggcugagccccuggccuccuaccuccucccaccucuugccucaggcccugccccagucacuccacccucagggcucucaccgggcugucaaugacagcuuuuccauguaaggcauggugcuagguuccaggaggaacaggggaugcauggaggcauaaugguuagggagucaugacacacaaccaugaagaggccccauuaccaggcugcaccaggauacaagacaagaaaggaaaggaugaguagggacauacuaagaagcagcccucuccucuuggaaaagucaagcaaaacuuggaaaugaagagauuugaggggggccuggcagauggauagagcugggggaagggaaaagaaaggccucugcucaaguaacagccagaacuugggguugcuuggggagggcaccaggagcacugucuuaguuuggguucuuccaaagcagagcuugagcuaagggcuuggguacaggugauccuguauucuugagcuaagggcuuggguacaggugauccuguauuugggagguuaacucaggaagugagggcauaagguaaaacaagagagaggaaagccauuaagaguauguuaagucccuucaguaggccuugggaaccucugagaaaaguauagauugcccaagacaaaagacuggcagggugaucaguccaaagcauuuauuaggagaauguacuuaaugagugggcuacagcguauccucacaacagacagugagagagaguuguucuaccuggguauauccaaaacaagggggucaggguauggaguuuacgaggguucaagguauuugguucagggccagggccaguuuuuuucaguguuuugggcaacaaccugaauaccuuuucaaggcucuggcuugggcucaagccugcaggggaaaugcaacuggccaggucacagggcaaucaaguuacucuguguuucuuugucaggacacagaaaaaaaguggggaagcugggggacccuacaaggauccuuggcaggaaagcagggauuguguucauuugaggguuucacugucagugagagucucagcuuccaugcaacuguccaucacggcugcaacugaaaucagagcugggacacagcgcaccagaagcuaaagucuugaugccaucaaaggacaucccugccccauucacaucucugucacguccacuaaucggcaaaaggagaaaagugagagaagaugaccuaagugugacugcagcaggcagcucuggaaaaugaagccagagcagugagccagccccuccuccgaccaaggaggaaggaaagagcagccccagcacaggagagaaccacccagcccagaaguuccagggaaggaacucuccgguccaccauggaguaccucucagcucugaaccccagugacuuacucaggucaguaucuaauauaagcucggaguuuggacggagggucuggaccucagcuccaccaccccagcgaccuuuccgugucugugaucacaagcggaccauccggaaaggccugacagcugccacccgccaggagcugcuagccaaagcauuggagacccuacugcugaauggagugcuaacccuggugcuagaggaggauggaacugcaguggacagugaggacuucuuccagcugcuggaggaugacacgugccugaugguguugcagucuggucagagcuggagcccuacaaggaguggagugcugucauauggccugggacgggagaggcccaagcacagcaaggacaucacccgauucaccuuugacguguacaagcaaaacccucgagaccucuuuggcagccugaaugucaaagccacauucuacgggcucuacucuaugaguugggacuuucaaggacuuggcccaaagaaaguacucagggagcuccuucguuggaccuccacacugcugcaaggccugggccauauguugcugggaauuuccuccacccuucgucaugcaguggagggggcugagcaguggcagcagaagggccgccuccauuccuacuaaggggcucugagcuucugcccccagaaucauuccaaccgacccacugcaaagacuaugacagcaucaaauuucaggaccugcagacaguacaggcuagauaacccacccaauuuccccacuguccucugauccccucgugacagaaccuuucagcauaacgccucacaucccaagucuauacccuuaccugaagaaugcuguucuuuccuagccaccuuucuagccucccacuugcccugaaaggccaagaucaagaugucccccaggcaucuugaucccagccugacugcugcuacaucuaauccccuaccaaugccuccugucccuaaacuccccagcauacugaugacagcccucucugacuuuaccuugagaucugucuucauacccuuccccucaaacuaacaaaaacauuuccaauaaaaauaucaaauauuu

SEQ ID NO: 12 - RNA, 1217 nt, Homo sapiens
gacucauucccaccuuguccugggcugagaucccagguuuguaacagaaaacaccacuaaagccccagcacaggagagaaccacccagcccagaaguuccagggaaggaacucuccgguccaccauggaguaccucucagcucugaaccccagugacuuacucaggucaguaucuaauauaagcucggaguuuggacggagggucuggaccucagcuccaccaccccagcgaccuuuccgugucugugaucacaagcggaccauccggaaaggccugacagcugccacccgccaggagcugcuagccaaagcauuggagacccuacugcugaauggagugcuaacccuggugcuagaggaggauggaacugcaguggacagugaggacuucuuccagcugcuggaggaugacacgugccugaugguguugcagucuggucagagcuggagcccuacaaggaguggagugcugucauauggccugggacgggagaggcccaagcacagcaaggacaucgcccgauucaccuuugacguguacaagcaaaacccucgagaccucuuuggcagccugaaugucaaagccacauucuacgggcucuacucuaugaguugugacuuucaaggacuuggcccaaagaaaguacucagggagcuccuucguuggaccuccacacugcugcaaggccugggccauauguugcugggaauuuccuccacccuucgucaugcaguggagggggcugagcaguggcagcagaagggccgccuccauuccuacuaaggggcucugagcuucugcccccagaaucauuccaaccgacccacugcaaagacuaugacagcaucaaauuucaggaccugcagacaguacaggcuagauaacccacccaauuuccccacuguccucugauccccucgugacagaaccuuucagcauaacgccucacaucccaagucuauacccuuaccugaagaaugcuguucuuuccuagccaccuuucuagccucccacuugcccugaaaggccaagaucaagaugucccccaggcaucuugaucccagccugacugcugcuacaucuaauccccuaccaaugccuccugucccuaaacuccccagcauacugaugacagcccucucugacuuuaccuugagaucugucuucauacccuuccccucaaacuaaaaaaaaaaaaaaaaaaaaaaaaaaaaaa

SEQ ID NO: 13 - DNA, 1602 bp, Homo sapiens
gagccactcataaactgcagcttctcagagcctgagagccagaaaccgtccccagaaattccctccatagaaataaaaaaacaccagaagtcacatttcatccttttacatggttcccatctaccctcacaacacatgtcatcaccaaagacacacatacaagctccaatggcttttgccaggcaattcttcctccaggaccccatctggcccctccctcatccctccccttggactttgcccttcttactggccaggcaggggggccagagtccaggcttgactcattcccaccttgtcctgggctgagatcccaggtttgtaacagaaaacaccactaaagccccagcacaggagagaaccacccagcccagaagttccagggaaggaactctccggtccaccatggagtacctctcagctctgaaccccagtgacttactcaggtcagtatctaatataagctcggagtttggacggagggtctggacctcagctccaccaccccagcgacctttccgtgtctgtgatcacaagcggaccatccggaaaggcctgacagctgccacccgccaggagctgctagccaaagcattggagaccctactgctgaatggagtgctaaccctggtgctagaggaggatggaactgcagtggacagtgaggacttcttccagctgctggaggatgacacgtgcctgatggtgttgcagtctggtcagagctggagccctacaaggagtggagtgctgtcatatggcctgggacgggagaggcccaagcacagcaaggacatcgcccgattcacctttgacgtgtacaagcaaaaccctcgagacctctttggcagcctgaatgtcaaagccacattctacgggctctactctatgagttgtgactttcaaggacttggcccaaagaaagtactcagggagctccttcgttggacctccacactgctgcaaggcctgggccatatgttgctgggaatttcctccacccttcgtcatgcagtggagggggctgagcagtggcagcagaagggccgcctccattcctactaaggggctctgagcttctgcccccagaatcattccaaccgacccactgcaaagactatgacagcatcaaatttcaggacctgcagacagtacaggctagataacccacccaatttccccactgtcctctgatcccctcgtgacagaacctttcagcataacgcctcacatcccaagtctatacccttacctgaagaatgctgttctttcctagccacctttctggcctcccacttgccctgaaaggccaagatcaagatgtcccccaggcatcttgatcccagcctgactgctgctacatctaatcccctaccaatgcctcctgtccctaaactccccagcatactgatgacagccctctctgactttaccttgagatctgtcttcatacccttcccctcaaactaacaaaaacatttccaataaaaatatcaaatatttaccactaagacttctgactccaatttaaaccaggaaagggatggggtggataccccattttgccctcccccatcaacacccagtcccagatccaaagcc

SEQ ID NO: 14 - DNA, 2294 bp, Homo sapiens
gccagcgctgcgaccgcctgcagaaggttgactgcgtggtagggggcccagagcaagccgaaggcaagcacgatggcgctcaccagccggcccacccgcgccccgtgccgcccggagccccagcgggcgccccgcagccgtgccagcgtcacgctgtagcagccgagcatcagcccgaaaggaagcacgaaagcggtcagagtctccaggctcaggtgggcggcggcgtggaccggcgacgggtggcacagctggcatacgcggtccctccacaggtggcggtagacggcggccgggacggcgagcaacagggcggccagccagaccgccagcagcaggcggcgggccagggccgggctgcgcagccgaggcgccaggaaggggcgggtgactgcgaggcagcgctgcaggctgagcaggccggtgagcagcacgctggcgtacatgctgagcgcgcacacgtagtacaccgccttgcagcccgcctggcccagcggccaggcctgccgggtcaggaaggccacaaagagcggcgtgagcagcagcaccgcgccgtcggccagcgccaggtgcagcacaagcgtggccgccagcggtcgcccccgtgcaggccgccagcccgccaagctccacaccacgaagccgttgccaggcagccccagcagcgccgccagcagcaggaaggctgtgcctgtggcccgcgaagtcttccagctcagcagtgtctcgttccctgggggacggtagcagaccgacatccttctgggcctacaggacacagaaaaaaagtggggaagctgggggaccctacaaggatccttggcaggaaagcagggattgtgttcatttgagggtttcactgtcagtgagagtctcagcttccatgcaactgtccatcacggctgcaactgaaatcagagctgggacacagcgcaccagaagctaaagtcttgatgccatcaaaggacatccctgccccattcacatctctgtcacgtccactaatcggcaaaaggagaaaagtgagagaagatgacctaagtgtgactgcagcaggcagctctggaaaatgaagccagagcagtgagccagcccctcctccgaccaaggaggaaggaaagagcagccccagcacaggagagaaccacccagcccagaagttccagggaaggaactctccggtccaccatggagtacctctcagctctgaaccccagtgacttactcaggtcagtatctaatataagctcggagtttggacggagggtctggacctcagctccaccaccccagcgacctttccgtgtctgtgatcacaagcggaccatccggaaaggcctgacagctgccacccgccaggagctgctagccaaagcattggagaccctactgctgaatggagtgctaaccctggtgctagaggaggatggaactgcagtggacagtgaggacttcttccagctgctggaggatgacacgtgcctgatggtgttgcagtctggtcagagctggagccctacaaggagtggagtgctgtcatatggcctgggacgggagaggcccaagcacagcaaggacatcgcccgattcacctttgacgtgtacaagcaaaaccctcgagacctctttggcagcctgaatgtcaaagccacattctacgggctctactctatgagttgtgactttcaaggacttggcccaaagaaagtactcagggagctccttcgttggacctccacactgctgcaaggcctgggccatatgttgctgggaatttcctccacccttcgtcatgcagtggagggggctgagcagtggcagcagaagggccgcctccattcctactaaggggctctgagcttctgcccccagaatcattccaaccgacccactgcaaagactatgacagcatcaaatttcaggacctgcagacagtacaggctagataacccacccaatttccccactgtcctctgatcccctcgtgacagaacctttcagcataacgcctcacatcccaagtctatacccttacctgaagaatgctgttctttcctagccacctttctggcctcccacttgccctgaaaggccaagatcaagatgtcccccaggcatcttgatcccagcctgactgctgctacatctaatcccctaccaatgcctcctgtccctaaactccccagcatactgatgacagccctctctgactttaccttgagatctgtcttcatacccttcccctcaaactaacaaaaacatttccaataaaaatatcaaatatttaccactaa

SEQ ID NO: 15 - DNA, 2409 bp, Homo sapiens
ttgactgcgtggtagggggcccagagcaagccgaaggcaagcacgatggcgctcaccagccggcccacccgcgccccgtgccgcccggagccccagcgggcgccccgcagccgtgccagcgtcacgctgtagcagccgagcatcagcccgaaaggaagcacgaaagcggtcagagtctccaggctcaggtgggcggcggcgtggaccggcgacgggtggcacagctggcatacgcggtccctccacaggtggcggtagacggcggccgggacggcgagcaacagggcggccagccagaccgccagcagcaggcggcgggccagggccgggctgcgcagccgaggcgccaggaaggggcgggtgactgcgaggcagcgctgcaggctgagcaggccggtgagcagcacgctggcgtacatgctgagcgcgcacacgtagtacaccgccttgcagcccgcctggcccagcggccaggcctgccgggtcaggaaggccacaaagagcggcgtgagcagcagcaccgcgccgtcggccagcgccaggtgcagcacaagcgtggccgccagcggtcgcccccgtgcaggccgccagcccgccaagctccacaccacgaagccgttgccaggcagccccagcagcgccgccagcagcaggaaggctgtgcctgtggcccgcgaagtcttccagctcagcagtgtctcgttccctgggggacggtagcagaccgacatccttctgggcctacagcctgcctcttttctgcctgggagtcctgacttccacgaggacccagaccccacctcaaacacaactccttcttggaacccagatcccctgctcccagtcagttgacctgccccactcctggcctccttcccagagctcagtggacacagaaaaaaagtggggaagctgggggaccctacaaggatccttggcaggaaagcagggattgtgttcatttgagggtttcactgtcagtgagagtctcagcttccatgcaactgtccatcacggctgcaactgaaatcagagctgggacacagcgcaccagaagctaaagtcttgatgccatcaaaggacatccctgccccattcacatctctgtcacgtccactaatcggcaaaaggagaaaagtgagagaagatgacctaagtgtgactgcagcaggcagctctggaaaatgaagccagagcagtgagccagcccctcctccgaccaaggaggaaggaaagagcagccccagcacaggagagaaccacccagcccagaagttccagggaaggaactctccggtccaccatggagtacctctcagctctgaaccccagtgacttactcaggtcagtatctaatataagctcggagtttggacggagggtctggacctcagctccaccaccccagcgacctttccgtgtctgtgatcacaagcggaccatccggaaaggcctgacagctgccacccgccaggagctgctagccaaagcattggagaccctactgctgaatggagtgctaaccctggtgctagaggaggatggaactgcagtggacagtgaggacttcttccagctgctggaggatgacacgtgcctgatggtgttgcagtctggtcagagctggagccctacaaggagtggagtgctgtcatatggcctgggacgggagaggcccaagcacagcaaggacatcgcccgattcacctttgacgtgtacaagcaaaaccctcgagacctctttggcagcctgaatgtcaaagccacattctacgggctctactctatgagttgtgactttcaaggacttggcccaaagaaagtactcagggagctccttcgttggacctccacactgctgcaaggcctgggccatatgttgctgggaatttcctccacccttcgtcatgcagtggagggggctgagcagtggcagcagaagggccgcctccattcctactaaggggctctgagcttctgcccccagaatcattccaaccgacccactgcaaagactatgacagcatcaaatttcaggacctgcagacagtacaggctagataacccacccaatttccccactgtcctctgatcccctcgtgacagaacctttcagcataacgcctcacatcccaagtctatacccttacctgaagaatgctgttctttcctagccacctttctggcctcccacttgccctgaaaggccaagatcaagatgtcccccaggcatcttgatcccagcctgactgctgctacatctaatcccctaccaatgcctcctgtccctaaactccccagcatactgatgacagccctctctgactttaccttgagatctgtcttcatacccttcccctcaaactaacaaaaacatttccaataaaaatatcaaatatttaccactaa

SEQ ID NO: 16 - DNA, 2540 bp, Homo sapiens
cccttccggtggagccagcgctgcgaccgcctgcagaaggttgactgcgtggtagggggcccagagcaagccgaaggcaagcacgatggcgctcaccagccggcccacccgcgccccgtgccgcccggagccccagcgggcgccccgcagccgtgccagcgtcacgctgtagcagccgagcatcagcccgaaaggaagcacgaaagcggtcagagtctccaggctcaggtgggcggcggcgtggaccggcgacgggtggcacagctggcatacgcggtccctccacaggtggcggtagacggcggccgggacggcgagcaacagggcggccagccagaccgccagcagcaggcggcgggccagggccgggctgcgcagccgaggcgccaggaaggggcgggtgactgcgaggcagcgctgcaggctgagcaggccggtgagcagcacgctggcgtacatgctgagcgcgcacacgtagtacaccgccttgcagcccgcctggcccagcggccaggcctgccgggtcaggaaggccacaaagagcggcgtgagcagcagcaccgcgccgtcggccagcgccaggtgcagcacaagcgtggccgccagcggtcgcccccgtgcaggccgccagcccgccaagctccacaccacgaagccgttgccaggcagccccagcagcgccgccagcagcaggaaggctgtgcctgtggcccgcgaagtcttccagctcagcagtgtctcgttccctgggggacggtagcagaccgacatccttctgggcctacagcctgcctcttttctgcctgggagtcctgacttccacgaggacccagaccccacctcaaacacaactccttcttggaacccagatcccctgctcccagtcagttgacctgccccactcctggcctccttcccagagctcagtggacacagaaaaaaagtggggaagctgggggaccctacaaggatccttggcaggaaagcagggattgtgttcatttgagggtttcactgtcagtgagagtctcagcttccatgcaactgtccatcacggctgcaactgaaatcagagctgggacacagcgcaccagaagctaaagtcttgatgccatcaaaggacatccctgccccattcacatctctgtcacgtccactaatcggcaaaaggagaaaagtgagagaagatgacctaagtgtgactgcagcaggcagctctggaaaatgaagccagagcagtgagccagcccctcctccgaccaaggaggaaggaaagagcagccccagcacaggagagaaccacccagcccagaagttccagggaaggaactctccggtccaccatggagtacctctcagctctgaaccccagtgacttactcaggtcagtatctaatataagctcggagtttggacggagggtctggacctcagctccaccaccccagcgacctttccgtgtctgtgatcacaagcggaccatccggaaaggcctgacagctgccacccgccaggagctgctagccaaagcattggagaccctactgctgaatggagtgctaaccctggtgctagaggaggatggaactgcagtggacagtgaggacttcttccagctgctggaggatgacacgtgcctgatggtgttgcagtctggtcagagctggagccctacaaggagtggagtgctgtcatatggcctgggacgggagaggcccaagcacagcaaggacatcgcccgattcacctttgacgtgtacaagcaaaaccctcgagacctctttggcagcctgaatgtcaaagccacattctacgggctctactctatgagttgtgactttcaaggacttggcccaaagaaagtactcagggagctccttcgttggacctccacactgctgcaaggcctgggccatatgttgctgggaatttcctccacccttcgtcatgcagtggagggggctgagcagtggcagcagaagggccgcctccattcctactaaggggctctgagcttctgcccccagaatcattccaaccgacccactgcaaagactatgacagcatcaaatttcaggacctgcagacagtacaggctagataacccacccaatttccccactgtcctctgatcccctcgtgacagaacctttcagcataacgcctcacatcccaagtctatacccttacctgaagaatgctgttctttcctagccacctttctggcctcccacttgccctgaaaggccaagatcaagatgtcccccaggcatcttgatcccagcctgactgctgctacatctaatcccctaccaatgcctcctgtccctaaactccccagcatactgatgacagccctctctgactttaccttgagatctgtcttcatacccttcccctcaaactaacaaaaacatttccaataaaaatatcaaatatttaccactaagacttctgactccaatttaaaccaggaaagggatggggtggataccccattttgccctcccccatcaacacccagtcccagatccaaagcc

SEQ ID NO: 17 - DNA, 2540 bp, Homo sapiens; identical to SEQ ID NO: 16

SEQ ID NO: 18 - DNA, 1511 bp, Homo sapiens
cacatttcatccttttacatggttcccatctaccctcacaacacatgtcatcaccaaagacacacatacaagctccaatggcttttgccaggcaattcttcctccaggaccccatctggcccctccctcatccctccccttggactttgcccttcttactggccaggcaggggggccagagtccaggcttgactcattcccaccttgtcctgggctgagatcccaggtttgtaacagaaaacaccactaaagccccagcacaggagagaaccacccagcccagaagttccagggaaggaactctccggtccaccatggagtacctctcagctctgaaccccagtgacttactcaggtcagtatctaatataagctcggagtttggacggagggtctggacctcagctccaccaccccagcgacctttccgtgtctgtgatcacaagcggaccatccggaaaggcctgacagctgccacccgccaggagctgctagccaaagcattggagaccctactgctgaatggagtgctaaccctggtgctagaggaggatggaactgcagtggacagtgaggacttcttccagctgctggaggatgacacgtgcctgatggtgttgcagtctggtcagagctggagccctacaaggagtggagtgctgtcatatggcctgggacgggagaggcccaagcacagcaaggacatcgcccgattcacctttgacgtgtacaagcaaaaccctcgagacctctttggcagcctgaatgtcaaagccacattctacgggctctactctatgagttgtgactttcaaggacttggcccaaagaaagtactcagggagctccttcgttggacctccacactgctgcaaggcctgggccatatgttgctgggaatttcctccacccttcgtcatgcagtggagggggctgagcagtggcagcagaagggccgcctccattcctactaaggggctctgagcttctgcccccagaatcattccaaccgacccactgcaaagactatgacagcatcaaatttcaggacctgcagacagtacaggctagataacccacccaatttccccactgtcctctgatcccctcgtgacagaacctttcagcataacgcctcacatcccaagtctatacccttacctgaagaatgctgttctttcctagccacctttctggcctcccacttgccctgaaaggccaagatcaagatgtcccccaggcatcttgatcccagcctgactgctgctacatctaatcccctaccaatgcctcctgtccctaaactccccagcatactgatgacagccctctctgactttaccttgagatctgtcttcatacccttcccctcaaactaacaaaaacatttccaataaaaatatcaaatatttaccactaagacttctgactccaatttaaaccaggaaagggatggggtggataccccattttgccctcccccatcaacacccagtcccagatccaaagcc

SEQ ID NO: 19 - DNA, 1329 bp, Homo sapiens
agatcccaggtttgtaacagaaaacaccactaaagccccagcacaggagagaaccacccagcccagaagttccagggaaggaactctccggtccaccatggagtacctctcagctctgaaccccagtgacttactcaggtcagtatctaatataagctcggagtttggacggagggtctggacctcagctccaccaccccagcgacctttccgtgtctgtgatcacaagcggaccatccggaaaggcctgacagctgccacccgccaggagctgctagccaaagcattggagaccctactgctgaatggagtgctaaccctggtgctagaggaggatggaactgcagtggacagtgaggacttcttccagctgctggaggatgacacgtgcctgatggtgttgcagtctggtcagagctggagccctacaaggagtggagtgctgtcatatggcctgggacgggagaggcccaagcacagcaaggacatcgcccgattcacctttgacgtgtacaagcaaaaccctcgagacctctttggcagcctgaatgtcaaagccacattctacgggctctactctatgagttgtgactttcaaggacttggcccaaagaaagtactcagggagctccttcgttggacctccacactgctgcaaggcctgggccatatgttgctgggaatttcctccacccttcgtcatgcagtggagggggctgagcagtggcagcagaagggccgcctccattcctactaaggggctctgagcttctgcccccagaatcattccaaccgacccactgcaaagactatgacagcatcaaatttcaggacctgcagacagtacaggctagataacccacccaatttccccactgtcctctgatcccctcgtgacagaacctttcaagcataacgcctacatcccaagtctatacccttacctgaagaatgctgttctttcctagccacctttctagcctcccacttgccctgaaaggccaagatcaagatgtcccccaggcatcttgatcccagcctgactgctgctacatctaatcccctaccaatgcctcctgtccctaaactccccagcatactgatgacagccctctctgactttaccttgagatctgtcttcatacccttcccctcaaactaacaaaaacatttccaataaaaatatcaaatatttaccactaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 20 - DNA, 2289 bp, Homo sapiens
tcgcggccgcgtcracgcgtggtagggggcccagagcaagccgaaggcaagcacgatggcgctcaccagccggcccacccgcgccccgtgccgcccggagccccagcgggcgccccgcagccgtgccagcgtcacgctgtagcagccgagcatcagccgaaaggaagcacgaaagcggtcagagtctccaggctcaggtgggcggcggcgtggaccggcgacgggtggcacagctggcatacgcggtccctccacaggtggcggtagacggcggccgggacggcgagcaacagggcggccagccagaccgccagcagcaggcggcgggccagggccgggctgcgcagccgaggcgccaggaaggggcgggtgactgcgaggcagcgctgcaggctgagcaggccggtgagcagcacgcttggcgtacatgctgagcgcgcacacgtagtacaccgccttgcagcccgcctggcccagcggccaggcctgccggtcaggaaggccacaaagagcggcgtgagcagcagcaccgcgccgtcggccagcgccaggtgcagcacaagcgtggccgccagcggtcgcccccgtgcaggctgccagcccgccaagctccacaccacgaagccgttgccaggcagccccagcagcgccgccagcagcaggaaggctgtgcctgtggcccgcgaagtcttccagctcagcagtgtctcgttccctgggggacggtagcagaccgacatccttctgggcctacaggacacagaaaaaaagtggggaagctgggggaccctacaaggatccttggcaggaaagcagggattgtgttcattttgagggtttcactgtcagtgagagtctcagcttccatgcaactgtccatcacggctgcaactgaaatcagagctgggacacagcgcaccagaagctaaagtcttgatgccatcaaaggacatcccctgccccattcacayattcacatctctgtcacgtccactaatcggcaaaaggagaaaagtgagagaagatgacctaagtgtgactgcagcaggcagctctggaaaatgaagccagagcagtgagccagcccctcctccgaccaaggaggaaggaaagagcagccccagcacaggagagaaccacccagcccagaagttccagggaaggaactctccggtccaccatggagtacctctcagctctgaaccccagtgacttactcaggtcagtatctaatataagctcggagtttggacggagggtctggacctcagctccaccaccccagcgacctttccgtgtctgtgatcacaagcggaccatccggaaaggcctgacagctgccacccgccaggagctgctagccaaagcattggagaccctactgctgaatggagtgctaaccctggtgctagaggaggatggaactgcagtggacagtgaggacttcttccagctgctggaggatgacacgtgcctgatggtgttgcagtctggtcagagctggagccctacaaggagtggagtgctgtcatatgggcctggacgggagagccccaagcacagcaaggacatcggccgattcacctttgacgtgtacaagcaaaaccctcgagacctctttggcagcctgaatgtcaaagccacattctacgggctctactctatgagttgtgactttcaaggacttggcccaaagaaagtactcagggagctccttcgttggacctccacactgctgcaaggcctgggccatatgttgctgggaatttcctccacccttcgtcatgcagtggagggggctgagcagtggcagcagaagggccgcctccattcctactaaggggctctgagcttctgcccccagaatcattccaaccgacccactgcaaagactatgacagcatcaaatttcaggacctgcagacagtacaggctagataacccacccaatttccccactgtcctctgatcccctcgtgacagaacctttcagcataacgcctcacatcccaagtctatacccttacctgaagaatgctgttctttcctagccacctttctagcctcccacttgccctgaaaggccaagatcaagatgtcccccaggcatcttgatcccagcctgactgctgctacatctaatcccctaccaatgcctcctgtccctaaactccccagcatactgatgacagccctctctgactttaccttgagatctgtcttcatacccttcccctcaaactaacaaaaacatttccaataaaaatatcaaatatttaccgtcaaccc

SEQ ID NO: 21 - DNA, 1206 bp, Homo sapiens
aggtttgtaacatgaaaacaccactaaagccccagcacaggagagaaccacccagcccagaagttccagggaaggaactctccggtccaccatggagtacctctcagctctgaaccccagtgacttactcaggtcagtatctaatataagctcggagtttggacggagggtctggacctcagctccaccaccccagcgacctttccgtgtctgtgatcacaagcggaccatccggaaaggcctgacagctgccacccgccaggagctgctagccaaagcattggagaccctactgctgaatggagtgctaaccctggtgctagaggaggatggaactgcagtggacagtgaggacttcttccagctgctggaggatgacacgtgcctgatggtgttgcagtctggtcagagctggagccctacaaggagtggagtgctgtcatatggcctgggacgggagaggcccaagcacagcaaggacatcgcccgattcacctttgacgtgtacaagcaaaaccctcgagacctctttggcagcctgaatgtcaaagccacattctacgggctctactctatgagttgtgactttcaaggacttggcccaaagaaagtactcagggagctccttcgttggacctccacactgctgcaaggcctgggccatatgttgctgggaatttcctccacccttcgtcatgcagtggagggggctgagcagtggcagcagaagggccgcctccattcctactaaggggctctgagcttctgcccccagaatcattccaaccgaccactgcaaagactatgacagcatcaaatttcaggacctgcagacagtacaggctagataacccacccaatttccccactgtcctctgatcccctcgtgacagaacctttcagcataacgcctcacatcccaagtctatacccttacctgaagaatgctgttctttcctagccacctttctggcctcccacttgccctgaaaggccaagatcaagatgtcccccaggcatcttgatcccagcctgactgctgctacatctaatcccctaccaatgcctcctgtccctaaactccccagcatactgatgacagccctctctgactttaccttgagatctgtcttcatacccttcccctcaaactaacaaaaacatttccaataaaaatatcaaatatttaaaaaaaaaaaaaaaaaa

SEQ ID NO: 22 - DNA, 3826 bp, Homo sapiens
agcttcgccaaggccccttccggtggagccagcgctgcgaccgcctgcagaaggttgactgcgtggtagggggcccagagcaagccgaaggcaagcacgatggcgctcaccagccggcccacccgcgccccgtgccgcccggagccccagcgggcgccccgcagccgtgccagcgtcacgctgtagcagccgagcatcagcccgaaaggaagcacgaaagcggtcagagtctccaggctcaggtgggcggcggcgtggaccggcgacgggtggcacagctggcatacgcggtccctccacaggtggcggtagacggcggccgggacggcgagcaacagggcggccagccagaccgccagcagcaggcggcgggccagggccgggctgcgcagccgaggcgccaggaaggggcgggtgactgcgaggcagcgctgcaggctgagcaggccggtgagcagcacgctggcgtacatgctgagcgcgcacacgtagtacaccgccttgcagcccgcctggcccagcggccaggcctgccgggtcaggaaggccacaaagagcggcgtgagcagcagcaccgcgccgtcggccagcgccaggtgcagcacaagcgtggccgccagcggtcgcccccgtgcaggccgccagcccgccaagctccacaccacgaagccgttgccaggcagccccagcagcgccgccagcagcaggaaggctgtgcctgtggcccgcgaagtcttccagctcagcagtgtctcgttccctgggggacggtagcagaccgacatccttctgggcctacaggtgggtggaaggcgccacagagggcgttcaggggtggggcaaaaccccacctgtgatgcccgatgagaaggtgccatgcctcctccttacttccctgcagcctgcctcttttctgcctgggagtcctgacttccacgaggacccagaccccacctcaaacacaactccttcttggaacccagatcccctgctcccagtcagttgacctgccccactcctggcctccttcccagagctcagtggtaaacaggcataaagtcctcaccccaggctgtcactatctctaccaccactcctctagtctggcccctccttctttgtccagccccattctagcacatctgggcaaaactggatggtggggtgtaaagggacgtgcacagatctacttaccaagctgggagcaagcaggattgggggcctggagaagctgaaaggttaagcagcagtaggcgaggtgcctactcctgtcctgtgcctatcacatttgcagaggtgacccaaacaactcagtcccccacctgccttatccttgcctgtttccagtctcctggtccggctgagcccctggcctcctacctcctcccacctcttgcctcaggccctgccccagtcactccaccctcagggctctcaccgggctgtcaatgacagcttttccatgtaaggcatggtgctaggttccaggaggaacaggggatgcatggaggcataatggttagggagtcatgacacacaaccatgaagaggccccattaccaggctgcaccaggatacaagacaagaaaggaaaggatgagtagggacatactaagaagcagccctctcctcttggaaaagtcaagcaaaacttggaaatgaagagatttgaggggggcctggcagatggatagagctgggggaagggaaaagaaaggcctctgctcaagtaacagccagaacttggggttgcttggggagggcaccaggagcactgtcttagtttgggttcttccaaagcagagcttgagctaagggcttgggtacaggtgatcctgtattcttgagctaagggcttgggtacaggtgatcctgtatttgggaggttaactcaggaagtgagggcataaggtaaaacaagagagaggaaagccattaagagtatgttaagtcccttcagtaggccttgggaacctctgagaaaagtatagattgcccaagacaaaagactggcagggtgatcagtccaaagcatttattaggagaatgtacttaatgagtgggctacagcgtatcctcacaacagacagtgagagagagttgttctacctgggtatatccaaaacaagggggtcagggtatggagtttacgagggttcaaggtatttggttcagggccagggccagtttttttcagtgttttgggcaacaacctgaataccttttcaaggctctggcttgggctcaagcctgcaggggaaatgcaactggccaggtcacagggcaatcaagttactctgtgtttctttgtcaggacacagaaaaaaagtggggaagctgggggaccctacaaggatccttggcaggaaagcagggattgtgttcatttgagggtttcactgtcagtgagagtctcagcttccatgcaactgtccatcacggctgcaactgaaatcagagctgggacacagcgcaccagaagctaaagtcttgatgccatcaaaggacatccctgccccattcacatctctgtcacgtccactaatcggcaaaaggagaaaagtgagagaagatgacctaagtgtgactgcagcaggcagctctggaaaatgaagccagagcagtgagccagcccctcctccgaccaaggaggaaggaaagagcagccccagcacaggagagaaccacccagcccagaagttccagggaaggaactctccggtccaccatggagtacctctcagctctgaaccccagtgacttactcaggtcagtatctaatataagctcggagtttggacggagggtctggacctcagctccaccaccccagcgacctttccgtgtctgtgatcacaagcggaccatccggaaaggcctgacagctgccacccgccaggagctgctagccaaagcattggagaccctactgctgaatggagtgctaaccctggtgctagaggaggatggaactgcagtggacagtgaggacttcttccagctgctggaggatgacacgtgcctgatggtgttgcagtctggtcagagctggagccctacaaggagtggagtgctgtcatatggcctgggacgggagaggcccaagcacagcaaggacatcacccgattcacctttgacgtgtacaagcaaaaccctcgagacctctttggcagcctgaatgtcaaagccacattctacgggctctactctatgagttgggactttcaaggacttggcccaaagaaagtactcagggagctccttcgttggacctccacactgctgcaaggcctgggccatatgttgctgggaatttcctccacccttcgtcatgcagtggagggggctgagcagtggcagcagaagggccgcctccattcctactaaggggctctgagcttctgcccccagaatcattccaaccgacccactgcaaagactatgacagcatcaaatttcaggacctgcagacagtacaggctagataacccacccaatttccccactgtcctctgatcccctcgtgacagaacctttcagcataacgcctcacatcccaagtctatacccttacctgaagaatgctgttctttcctagccacctttctagcctcccacttgccctgaaaggccaagatcaagatgtcccccaggcatcttgatcccagcctgactgctgctacatctaatcccctaccaatgcctcctgtccctaaactccccagcatactgatgacagccctctctgactttaccttgagatctgtcttcatacccttcccctcaaactaacaaaaacatttccaataaaaatatcaaatattt

SEQ ID NO: 23 - DNA, 1217 bp, Homo sapiens
gactcattcccaccttgtcctgggctgagatcccaggtttgtaacagaaaacaccactaaagccccagcacaggagagaaccacccagcccagaagttccagggaaggaactctccggtccaccatggagtacctctcagctctgaaccccagtgacttactcaggtcagtatctaatataagctcggagtttggacggagggtctggacctcagctccaccaccccagcgacctttccgtgtctgtgatcacaagcggaccatccggaaaggcctgacagctgccacccgccaggagctgctagccaaagcattggagaccctactgctgaatggagtgctaaccctggtgctagaggaggatggaactgcagtggacagtgaggacttcttccagctgctggaggatgacacgtgcctgatggtgttgcagtctggtcagagctggagccctacaaggagtggagtgctgtcatatggcctgggacgggagaggcccaagcacagcaaggacatcgcccgattcacctttgacgtgtacaagcaaaaccctcgagacctctttggcagcctgaatgtcaaagccacattctacgggctctactctatgagttgtgactttcaaggacttggcccaaagaaagtactcagggagctccttcgttggacctccacactgctgcaaggcctgggccatatgttgctgggaatttcctccacccttcgtcatgcagtggagggggctgagcagtggcagcagaagggccgcctccattcctactaaggggctctgagcttctgcccccagaatcattccaaccgacccactgcaaagactatgacagcatcaaatttcaggacctgcagacagtacaggctagataacccacccaatttccccactgtcctctgatcccctcgtgacagaacctttcagcataacgcctcacatcccaagtctatacccttacctgaagaatgctgttctttcctagccacctttctagcctcccacttgccctgaaaggccaagatcaagatgtcccccaggcatcttgatcccagcctgactgctgctacatctaatcccctaccaatgcctcctgtccctaaactccccagcatactgatgacagccctctctgactttaccttgagatctgtcttcatacccttcccctcaaactaaaaaaaaaaaaaaaaaaaaaaaaaaaaaa

SEQ ID NO: 24 - protein, 219 aa, Homo sapiens
MEYLSALNPSDLLRSVSNISSEFGRRVWTSAPPPQRPFRVCDHKRTIRKGLTAATRQELLAKALETLLLNGVLTLVLEEDGTAVDSEDFFQLLEDDTCLMVLQSGQSWSPTRSGVLSYGLGRERPKHSKDIARFTFDVYKQNPRDLFGSLNVKATFYGLYSMSCDFQGLGPKKVLRELLRWTSTLLQGLGHMLLGISSTLRHAVEGAEQWQQKGRLHSY

SEQ ID NO: 25 - DNA, 23 bp, Artificial Sequence
  Description of Artificial Sequence: Synthetic oligonucleotide
  gRNA Recognition Sequence
agctgagaggtactccatggtgg

SEQ ID NO: 26 - DNA, 23 bp, Artificial Sequence
  Description of Artificial Sequence: Synthetic oligonucleotide
  gRNA Recognition Sequence
cagagctgagaggtactccatgg

SEQ ID NO: 27 - DNA, 23 bp, Artificial Sequence
  Description of Artificial Sequence: Synthetic oligonucleotide
  gRNA Recognition Sequence
gtcacctgagtaagtcactgggg

SEQ ID NO: 28 - DNA, 23 bp, Artificial Sequence
  Description of Artificial Sequence: Synthetic oligonucleotide
  gRNA Recognition Sequence
agtcacctgagtaagtcactggg

SEQ ID NO: 29 - DNA, 23 bp, Artificial Sequence
  Description of Artificial Sequence: Synthetic oligonucleotide
  gRNA Recognition Sequence
cagtcacctgagtaagtcactgg

SEQ ID NO: 30 - DNA, 23 bp, Artificial Sequence
  Description of Artificial Sequence: Synthetic oligonucleotide
  gRNA Recognition Sequence
gcttatattagatactgacctgg

SEQ ID NO: 31 - DNA, 23 bp, Artificial Sequence
  Description of Artificial Sequence: Synthetic oligonucleotide
  gRNA Recognition Sequence
gtcagtatctaatataagctcgg

SEQ ID NO: 32 - DNA, 23 bp, Artificial Sequence
  Description of Artificial Sequence: Synthetic oligonucleotide
  gRNA Recognition Sequence
atataagctcggagtttggacgg

SEQ ID NO: 33 - DNA, 23 bp, Artificial Sequence
  Description of Artificial Sequence: Synthetic oligonucleotide
  gRNA Recognition Sequence
cagacacggaaaggtcgctgggg

SEQ ID NO: 34 - DNA, 23 bp, Artificial Sequence
  Description of Artificial Sequence: Synthetic oligonucleotide
  gRNA Recognition Sequence
ttgtgatcacagacacggaaagg

SEQ ID NO: 35 - DNA, 23 bp, Artificial Sequence
  Description of Artificial Sequence: Synthetic oligonucleotide
  gRNA Recognition Sequence
tccgtgtctgtgatcacaagcgg

SEQ ID NO: 36 - DNA, 23 bp, Artificial Sequence
  Description of Artificial Sequence: Synthetic oligonucleotide
  gRNA Recognition Sequence
tccgcttgtgatcacagacacgg

SEQ ID NO: 37 - DNA, 23 bp, Artificial Sequence
  Description of Artificial Sequence: Synthetic oligonucleotide
  gRNA Recognition Sequence
agctgtcaggcctttccggatgg

SEQ ID NO: 38 - protein, 481 aa, Homo sapiens
MYDAERGWSLSFAGCGFLGFYHVGATRCLSEHAPHLLRDARMLFGASAGALHCVGVLSGIPLEQTLQVLSDLVRKARSRNIGIFHPSFNLSKFLRQGLCKCLPANVHQLISGKIGISLTRVSDGENVLVSDFRSKDEVVDALVCSCFIPFYSGLIPPSFRGVRYVDGGVSDNVPFIDAKTTITVSPFYGEYDICPKVKSTNFLHVDITKLSLRLCTGNLYLLSRAFVPPDLKVLGEICLRGYLDAFRFLEEKGICNRPQPGLKSSSEGMDPEVAMPSWANMSLDSSPESAALAVRLEGDELLDHLRLSILPWDESILDTLSPRLATALSEEMKDKGGYMSKICNLLPIRIMSYVMLPCTLPVESAIAIVQRLVTWLPDMPDDVLWLQWVTSQVFTRVLMCLLPASRSQMPVSSQQASPCTPEQDWPCWTPCSPKGCPAETKAEATPRSILRSSLNFFLGNKVPAGAEGLSTFPSFSLEKSL

SEQ ID NO: 39 - protein, 477 aa, Homo sapiens
MYDAERGWSLSFAGCGFLGFYHVGATRCLSEHAPHLLRDARMLFGASAGALHCVGVLSEQTLQVLSDLVRKARSRNIGIFHPSFNLSKFLRQGLCKCLPANVHQLISGKIGISLTRVSDGENVLVSDFRSKDEVVDALVCSCFIPFYSGLIPPSFRGVRYVDGGVSDNVPFIDAKTTITVSPFYGEYDICPKVKSTNFLHVDITKLSLRLCTGNLYLLSRAFVPPDLKVLGEICLRGYLDAFRFLEEKGICNRPQPGLKSSSEGMDPEVAMPSWANMSLDSSPESAALAVRLEGDELLDHLRLSILPWDESILDTLSPRLATALSEEMKDKGGYMSKICNLLPIRIMSYVMLPCTLPVESAIAIVQRLVTWLPDMPDDVLWLQWVTSQVFTRVLMCLLPASRSQMPVSSQQASPCTPEQDWPCWTPCSPKGCPAETKAEATPRSILRSSLNFFLGNKVPAGAEGLSTFPSFSLEKSL

SEQ ID NO: 40 - protein, 481 aa, Homo sapiens [sequence omitted]

SEQ ID NO: 41 - protein, 477 aa, Homo sapiens
MYDAERGWSLSFAGCGFLGFYHVGATRCLSEHAPHLLRDARMLFGASAGALHCVGVLSEQTLQVLSDLVRKARSRNIGIFHPSFNLSKFLRQGLCKCLPANVHQLISGKIGISLTRVSDGENVLVSDFRSKDEVVDALVCSCFMPFYSGLIPPSFRGVRYVDGGVSDNVPFIDAKTTITVSPFYGEYDICPKVKSTNFLHVDITKLSLRLCTGNLYLLSRAFVPPDLKVLGEICLRGYLDAFRFLEEKGICNRPQPGLKSSSEGMDPEVAMPSWANMSLDSSPESAALAVRLEGDELLDHLRLSILPWDESILDTLSPRLATALSEEMKDKGGYMSKICNLLPIRIMSYVMLPCTLPVESAIAIVQRLVTWLPDMPDDVLWLQWVTSQVFTRVLMCLLPASRSQMPVSSQQASPCTPEQDWPCWTPCSPKGCPAETKAEATPRSILRSSLNFFLGNKVPAGAEGLSTFPSFSLEKSL

SEQ ID NO: 42 - DNA, 23830 bp, Homo sapiens
atggtccgaggggggcggggctgacgtcgcgctgggaatgccctggccgagacactgaggcagggtagagagcgcttgcgggcgccgggcggagctgctgcggatcaggacccgagccgattcccgatcccgacccagatcctaacccgcgcccccgccccgccgccgccgccatgtacgacgcagagcgcggctggagcttgtccttcgcgggctgcggcttcctgggcttctaccacgtcggggcgacccgctgcctgagcgagcacgccccgcacctcctccgcgacgcgcgcatgttgttcggcgcttcggccggggcgttgcactgcgtcggcgtcctctccggtatcccgctgggtgcgtctggggacgctgcccgggctccacgtgcggagtgggtgccccctaggccggggagcgggggatccccaggggtcgcggggccctggaggagcgggcatcggacgcggacacggcggggtgcatcccgagggccccctccgaggcagatgcttcctgcgggggcgctgttcctgggcccgggaagggggcgttggaaccccgagcggtccgggccgaagcctgggactctcgtgcgtccccacccctacccccatcaggcgcccgtgcatgaagggagaccctcacctccggactgagagtcggagcgtctcggagcgacggggagtagggagcgggacccggggcggagggtagtgctggcccctgcggactccgggtcccctgtgtcctctcgggaggggctggacgggctgagctgccgaggggccgatttgccctgggccggacaaagagtggggctttggccggtcccccacggtgggctccttccctctggggattgagggactcaagacaccccgcgcctgcgcttttcttttctttttttctttttttttttttgagacggagtttcgctcagtcgcccaggctggagtgcagtggcgtgatctcaactcactgcaagctccacctcccaggttcacgccattctcctgcctcagcctcccgagtagctgggactacaggcgccagccaccaagcccggctaattttttgtattttttagtagagacggggtttcaccgtgttagccaggatggtctcgatctcctgacctcgtgatctgcccacctcggcctcccagaatgctggggttacaggcgtgagccactgctccctgctgcctacgctctctgggtcgcagcccagccttctgggggctgggtagcctcccagaagggcaaccctgggcatcctccagggcaggctaactggagtctagtggggaggggtaccttgaaagaggaaagttgtttcctcctcctcctcctcctccagtgtttgggacccttcctgggggctggagtgcatccctggacaccccccaatcccatcctcttctctagtttccactgacctaggcccaccctcccctctccggctcagtactcctggaaatgagattccgtacatttgaatcttgtcctaatgaaatatttgtccatgtgggtacctgtgtgtgtgtggtgggggtgcagacggagggtttgtttctcactagctggaactactggggtgtggtatgcttcctgggaatttgtgtgccacagtcctggaggcgaggagggggttgtgagccagtaggcaggggctggggcaagtagcattgtgaagctattgacacccagacgtccccaggcaggagattatgcccccattagcccccttttatctgggcttccttaacaatggactctttgccctgcctgccagagccagcagggagtgactgttcagtggtgaggaagcgggcagaggaagccctgccattgggtaggagcagtgggcagcccctgggctgactgggaggtggggattagggattagacagtcctggctgtctgccttcccctaagccagggggagaggagcaaagggcacgaaatgtggcctccaggaggattagaccgccacatgatcatttgcacaccctggggtttagcaacaataaaagtcagcttttttgtatcccaaggtggcctgtggacacccacatggacaaatgtttacactgggacagaattcaaatgcagaggtcccaggagcctaaagtacactcactctggtatagaaaggattccttactgggcagaggacaggtgcagcctggggctttcccaggcaggacacagggaggctcaggaaccaccaagtccctggaaggtggatctggaggcgttggcaggagccactccctgggttccagggctccaggttcctgctttaaccccctgtctcacagagggctgtgcacttgggggctgctgagcatgtcccagaggctgcatcctggacacagcacctcagtgcatctgagctgaggctaacttggcaggagggacaggcagaacctgccagccacgtgcaattccacccctctggccactcagggaaggagagctgtgagtcaagatcagatttgggtcaggacaggctggggcctgcctgtccctgtgcatcccaagatttatggctggccaggggttgggctgggaggggtggtcttgcatgccaggagagtgcagatcagcctgagaggccaggccagtaagtgaggtcagatctcctgcacctgatagcattaaggccatctacaccaaagctctaatgctgatatgttcctggcctctatgtggggcatggaggtggggcatggaggtgaggcctgctcgcctgggcttctggaagtgggagactcattcctgtggctgaggcctacagcagtgctgtgtggtaggaatacactggaagccatgatgtcattgtgcattttctagaagccacattgaataaagtaaaagacacaggtagaattaatttcattgagcccaatatatccaaaataatatcattttcacatctattcaatataaaaatttactaatgagatatttcatactaagccactgaaatccagtttgtatcttacacatctcagttttgacgagccacatttcaagggcgtgatagccacatgtggctcccatagtagacagtactggtctagagaaatgttggtggcatccttgctgtctggtttctggccttgccaaaagtattaccatcccagtgtggtacattctttcatgtatttgtctcctgtccccagagcagactctgcaggtcctctcagatcttgtgcggaaggccaggagtcggaacattggcatcttccatccatccttcaacttaagcaagttcctccgacagggtctctgcaaatgcctcccggccaatgtccaccagctcatctccggcaaaataggcatctctcttaccagagtgtctgatggggaaaacgttctggtgtctgactttcggtccaaagacgaagtcgtggatgtaagcagtttgcttatctggacgttgtcaagttagaaaagctgttttgggatgggtgtggtggctcatgcctgtcatcccggcactttgggaggccgaagcgggtgggttgcttgagcccaggagctcgagaccaacatgatgaaacccagtctctacaaaaattacagaaaaattagctaggcatggtgttgtgggcccatagtcccagctactagggaggctgaggcaggagaattgcttgagcctgggaggtggaggttgcagtaagtcatgatcatgccactgtactccagcccgggtgacagtgagatgctgtctggaaaaaaaaaaaaaagaaagactgttttgttttggaagcaacacaggcagttgtaggccccctgtgccagagtgacataaactctgtacacctccagtgatttggtccatgtttgtaaaccctgaatgttccagggcagtttcttttcttcactttttatctcttttttttgggtgggggggcggggtacagagtcttgctctgtctcccaggctggagtgcagtggcgcaatctcaacctcccgaggagctgggactacaggcacaggccatcacaccttgctaatgtttgtactttttgtagagacggggttttgccctgttgcccaggctggtcccaaactcctgcacccaagtaatctgcccacctctgcctggcagttacaatttcaaataattcctccctttccttcaacacttggctcatgaccgtccagtccaaggaacctgtcctgcaggtgtgcctctcccgagcttcctctatgcatcttccataatgaagatgccttctcactggaaaccctacaagggtgggaacgtgccttatttgcctgtatcctcagggtctagcagagagaagataatttgtaataccaaaacaccattaaattcagctgatgctttcataagcgctccttggaggaaggactccatttacttgacagatctgtgcaagacagcagcctggcgcgtctaacctgcagccagttgcatcctctgtttaaccttgtttgcggaagctttctctaaacagccagcacttgtctgttcccacatgggtccgttctcccagtgaatcaccgtggtgcctgctgactgctctgtagcacagtgcttcgcaaagtgtgatcctgggaccagcagagcagcagctcctttgagcttattggaatggcagaccctcaggtcccacctctgacctgctgcatgggaattctggggagggacgcagaatctctggttccacaggctctccggtgatgctaatgaataccggcatttgaacagcaccgatctagcccctttcagtccatgagccaacaacccttggtcctgtctgtggtgacccagtgtgactctcatggggagcaaggagaggaagttgaagttcactgacagggttgttaaggggattatgcaatagatgagacccatgggcctgaagtccgagggtgtatgttagttccccgttcttttgacccatggattaacctactctgtgcaaagggcattttcaagtttgttgccctgctcacttggagaaagcttatgaaggatcaggaaaattaaaagggtgctctcgcctataacttctctctcctttgctttcacaggccttggtatgttcctgcttcatccccttctacagtggccttatccctccttccttcagaggcgtggtaagtcggctttctctgctagcgctgagtcctgggggcctctgaagtgtgctcacacatctcctgcctgcagggcactggtgtcgggcacctcagggtctgtcccatggtggagccccatgcctcactgcctttcagacagagtagccacagctggccctatttccaggctacccgggcagcaaaacttactgcatgtgtaattaattatttggctatctgtaaggtaaactggctggttcacttaatctgcaccttaagcatcagatagcttctcagtgatctagttaaactatatgatgttggccaggcgcggtggctcatgtctgtaatcccagcactttgggagcctgaagcaggcagatcacttgaggtcaggagttcgagaccagcctggccaacagtgtgaaactctgtctctcctaaaaatacaaaaattagctgggcatggtggtgtgcacctgtaatcccagctgctcgggaggctgaggcaggagaattgcttgaacttgggaggcggaagttgcagtgagccaagatcgcaccactgcactccatcctgggtgacagagcgagactctatctcaaaaagaaaaaaaaaaaaaaggtaaataaagtatatgacactgaagaatctgttacccctggaaggtggagctttactcttagggggaactataacagtcatatatatatatttttttcttttctttttttttttttttgagatggagtctggctctgtcgcccaggctggagtgcagtggtgcaatctcggctcactgcaacctccacctcacaggttcaggcaattctcctgcctcaacctcccgagtagctgggattacaggtgcctgccgtcacgccaagctaatttttgtatttttagtagagacagggtttcatcatattggccaggctggtctccaactcctgacctcaggtgatccgcccgccttggcctcccaaagtgctgagattacaggcgtgagccatggtgcccggccaacaatcacatgtgttgtaaacaacaacaaaaatctgtcagcctggtctaacctagatttgtgctttgttttgttttgccactttgtgatgcacaggaggaagtttaggctgtaaaatactagccttttagggtaatttttgaactcacaagagcagcagcggaacctttgatgcaatcctgtatgtagcaccagcagagccacgtggcagagggactcgcattaggagcctcccattacagactacgtgctcctgtgcgttatcttatagggtccccacaaccaaggggagatgtgattattcatcctgtgtggctgtggggaacttgagagtcatacttgcccaaagagcacggccagcgagcttgcacccaggtcactctctgctcctctgtcagaacagggcatgtcttggttcactgcagggcggctcttctcattctctgtagtttggggtccaggatagtggtccacggagccactggagtgcccagctactgagtgaccaaagcatattttggatttccgacattgccacagcatggttgggcatcagcaggaccccaaccccttgttatgctggtggctttatgtggttatttgatcttccccagaactcagcaggagtgcacccagcagcaccgtagtgatgctctctggctccccagtgcacggttctggctttccttcctggtcgagagtttcaagccctctgggtcctactctgtccttttcagcccatagctttgttcaaaagctgctggcagtgttcagatttggctgagttcagtgaatatgtgcattggctgatttctgagccatgccagggggatggagaagccgaagcaggagtgtttgttctgcaggctctggagtaggcattgggtctgtgccggctcacttgctagtcttgcatccttccccaaccccctctggggatgtctggccacatcagaagacagtttgggttgtcagaactgggggagtaccaggccgaggtgggtggatcatgaggtcaggagatcgagaccatcctggctaacacagtgaaacctcatctctactaaacatacgaaaaaaattagctgggcgtggtggcgggcgcctgtagtcccagctactcgggaggctgaggcaggagaatggtgtgaacccggggggcggagcttgcagtgagctgagatcctgccactgcactccagcctgggcaacaaagcgagactccgtctcacaaacaaaacaaaacaaaacaaaacaaaatctgggggagtgccactggcatctgatgtatagaggcccgagatgctgtgtcatcacccgttgagtgcgctcataggcatcttcctgacaattagaacccattattcttcaaattcaatgcaagcaaattcaaagcattactgtgtacataccgcatgctaatcaattgcaccactggagctcctaaattcaaaacattactataaaaaagttcaaaatgcatggaaaagttgtacatggcaggagaatatttgggcttctgactaccccttgaatgaagatgatccaccagccgccttcctccttggtcttcactccagattcctagcatttcattctgtgtctctttatgcagtgaggtttttgtttgttttttgagacagagtctcactgtatcacctaggcctggagtgcagtggcgcgatctcagctcactgcaaccctcggctcctgggtttaagcgattctcctgcctcagcctcccgagcagctgagattacaagcacacatccccatgcccagctaatttttgtatttttagcagagacagggtttcaccatgttgcccaggctggtctcgaactcctggcctcaagtgatccatgtgcctcagccttccaaagtgctgggattacaggcgtgagccaccatgcccagctcctagtgaggtttttgatgccttgctacatctgccctagaaattgtgtgactacgattttggaaatgttgctgtgtaaacttgtgatcatttctggactccaggcaagaatcttgatggctaaggtgtggctgaacatgtctgattctctcctggacctgttttaggccaaactctgctctgaaattcctccgtgtggaagggcgggctggggagagcctcccagctggaatcttttggatgcctttctctgtgggtatctgatggctggctctgatggctggctgtgatggctgtggctggaaatcattgttgacatgagtttcacagatgcaggctctgtccaaattgtagcaaaagctgcctgccccagccgagctatgggcaataaggtggtttaaggatatagatgaaggaaaactcacccttagaataatttatccaaaatgctgctgtgttgtgggttagaggacattttctgaggtcccaggttcattgtttcatttaagtctcaaaagtccctccaggtgttggttctaattgtcaaagcatggggggagatgggctcatgggttaaaggtcttatcccagatttctgtatcctccttgcaagcagcaaaggggtctggatttgaatccatgaccatgtttctcctttgggtttccatcacactctgtccccgtgcactgagcaccctttagttcatatgacccccttaggcatgttacatgggcactcctataggtgcccatctggccctaggacttggccaacacaacatggactccagtttccatctgcctctttgccaggcacttttgtgcagtgcacacactgtacaacagtagacggcaaccctgagagccagagtagagcctgtcctagcaccggaatgctcggtaaggatttgtcgcaggagtgattccaaagccaatgtcctccctccatatcagcctgtttgtggctctgagaagctctgcccacatgtgaaagcttgttaagcacttaagcactaacccagagcttcagacagtgccagtcctttttccccttctttaaaagcgatatgtggatggaggagtgagtgacaacgtacccttcattgatgccaaaacaaccatcaccgtgtcccccttctatggggagtacgacatctgccctaaagtcaagtccacgaactttcttcatgtggacatcaccaagctcagtctacgcctctgcacagggaacctctaccttctctcgagagcttttgtccccccggatctcaaggtgagttggtggtgagggggcaggtgttctggggtgcagctcttctttgcctccctgattgccaggagctaccagttactgtctgcacaatcaaacagaaatagacctgtccttgatggttaacggaaataaaaggcgcttgtcccagaagctcaggtgaggcaccaccctgattatgggaatcacctgggaacatatacccagacctaaaactcagatccacttcccaggctgtggttatatagtcaggggggtgcagtatgggtattaggattttttattttttagttataaagatttttttttggtttgtttttgagacagggtcttgctctgccgcttaggctggagtgcagtggtgcaatcatagctcactgaagcctcagactcctgggttcaagcagtcctcccacctcagcctcctaaggagctgggacccacaggcatgcagcaccacacctggctaatttttaaaaattttgtggagtgttgcccaggctggtctcacactcctggcctcaagcgatcctcccaccccagcctcccaatgtgttgggattacaggcatgagccattgtacccagccactaagatgattcttatttggaaacacggtcaagaacaactgcgttcggtagtttaaccttttttgattgtggtggttttagtatgccttaccactctaccatagtaagaaatttgcagaccatgtacaccaacctttggtgctcctggggagaaagaaagaaggctatgcaatgcaatgcatgctcacagtccaagggagagggaaagctgtctaacaggattggttttcccgtgtgctttataagcagatgagtagaggagacagctcttattgtcctagtggcaattgggataggctgcaaagtttgttagggtggaggcttattccgggaccaagggagcccaaagaaacaagctcctgccaggcgcggtggctcacgcctgtaatcccagcactttgggaggctgaggcaggtggatcacctgaggtcaggagtttgagaccagcctggccaacatggtgaaaccccgtctccatgaaaaatacaaaaattacccgggcatggtggcgggcacctgtaatcccagctactagggaggctgaggcaggaaaatggcttgaacctcggaagtggaggtggccgttagccgagatcacgccactgcactccagcctgggcaacagagcaagactctgccttaaaaaaaaaaaaaaaaaaaagaaaagtaaaaggaaaaaaaagaggctctggcctgctggggtgcctgcaaagtctccgtggaagggtgacattcaagccgagacctccagggaactgtctcctgggagcacagagccctttgctcagcccccaggtggctcagtgcccccagccagcagactcagagcttgcatgattctttggtgctctctgcggtcttccaatgatgctgaaataaatggtgcttggtgtctccctgctgtagtccccttgcttgctttgctcacaggtgctgggagagatatgccttcgaggatatttggatgcattcaggttcttggaagagaagggtatgtatgggctgggaggatcagccatgcccttttgacaagcatttactagcggtcttggtaaagacttgagatttgccttagttctaacacttagtgcccaacgccttccttgtgttgctcaacctactcatgagcccaggagataggaaatctccgtcccattgtacagatggggaaacagaattttggaaaggagagccaagcagcacacacccctccctgaggggcagagccgagatttgaactgggatgtcatgactccagggccctctccctccccagggtccccttatctgaaggcggtttttctttccagctcgacctcttgtgacccttagtttaacaagggccgaagttaaagagtttctgcgcctggaccccaaatgaagcaatcagatttctcatctccagtcaggtgtgggtccaagcccactagacaagtttgctcttcccagagcacatttctgccttcaagtcatcctggcttgtcagggctgggggagttctgctgtagaaatattagagtggaaggaaaaagatgtgttgggagctatttttctttaatactaaaagttggttgatgaatttgtcgttggccaagaccaaggagactgcatttttaaggacatatgtgtatttatctgctcagaaaatgttcattgctgtgtgctagggatactgcagtgaacacagaggtgtgacccttgccagccttgtgagagaagtgagcagataagtaagcagaagggtgatgctgtgtcgatgggaaagtacaggtgccaatgagaaggcacaggtgtcaaggagaagacacaggatgctggaggctcatgcaggatggatctccaaggcccaggggaagaagggcctctcggaggacgtgaatccacattaagactttggggataagtaggagcgccttaggcatggggacccatggatgcgaggcctgtaggacacagacaggatggcatgaaggcctgtgcaactggaggggtggggatggggacactaagagatggctggaagtgtgggggtggggacactaagagatgactggagaagagggggtcaggagtggtgaaaaatgggagaggagggcaggctgggccttttggatacagggggattgcatcctgcagtggtagggagccactgagggctgctgcagtaggagtgaggggatcagaggagagctttggaagccccctggatgcgggacaggaagcgagataccagtgtctaggaggccagtgaggcagccacaggctccaccaggatcagggctgcgagggtcatgaggaggaaaccaatttgaaggagtccaggggaataggacttggaaatgaccgatgggacatttgggaagaggaagacagaagagcgcagtcccggcttctggctttagcagttgggcaaggggagatggggagatgtgcccatgggttgagggttgaggacattaggagggagccggtatggcaggaagagctggtgtgccagagatgctggaagcagcatctgcctgagaacagatacctggcaatattcctaagggaaagtgacatctcggagggtgaggagggcatctgatagggcctggaaagagccggggcaagcatgaatgtgaggttatcttggggggcaaggctcaggcgttgaggagcagcccctggtctcttcagcctgaagttggaagccagagttgggccaggtgcagctgtggttgtctgaagtccccctcccccagcccagtgtgccaatgctgtaagagcaagggccgctcactggtgctggtggctgagtcccagcacccaggacagggcctggcacatactggtgcccaatcctcccttctgggtgcttcttccaaggccttgtgatggaagtgagtaccctcttcgacatcagacccagcttcaaatcctggctctgctatgtattggctgcgtggctttagacaagtcttttaaccttgctgtgcttctgatttctcagctgaaaaatggagatgatgatagtggtttctgtaaggccttatggtgaagcacctagctcagggcctggaaggcaggtgtaaccagtggttcagttgttataaaccaacactaaccctcgcctttgcacctcatgaaaccagatatgtagatggagcccacaaagctagcaggagccaagctcacgtgtgtcctgctttaaagccccatacccctttctccgggtgacaaacacctgtgctcgttctcttcccttcccctcttccccttgcatttggctaataacaggccagctgcctgcctccctgcagtttggtagatgggtgggtaacgaccaccactcccacgttcgcctgatgggcttgttttccgtgcccttcacaggcatctgcaacaggccccagccaggcctgaagtcatcctcagaagggatggatcctgaggtcgccatgcccagctgggcaaacatgagtctggattcttccccggagtcggctgccttggctgtgaggctggagggagatgagctgctagaccacctgcgtctcagcatcctgccctgggatgagagcatcctggacaccctctcgcccaggctcgctacaggtacccactcctcggggtgagcacgggcagcaccttgttttctttcttgtgcattatggaggaagatggtactgccacatgggagcgatagggtgaggcaaccatgacaggtggttgggaacatctccttccatgtgtacagcctgggctgctgccatcactcccagcacagcccccaacccccccaatcctggaaccttgccaagtctcccttcccatggggtcatgaccaggaggaaaacaaactccagctgagccccttggggttccccatataggctcctgcctgtggcagctgggccctctgtacccctttccaactctgtctccctaacatggcacctgagctcctgccatcctggatttcatggaccccaaggatgggggtcctgcatctgggacttggcctattactcggagctccttttcagccgcctccctccacctgtccacccacctcaaggctcctttcttgagacctctcctaatttctcccttcccctaaacccacaattttgaacctccatcgaatggtgctgtattttataatgtcatcaaatatcaaatggagacagtgctatggtccaaatgattgtgtaccccccagaatttgtcttttgaaatcctaacccccaacatgatggtcttaggaggtggggcctttgggaggagattaggtcatgaggaaagggctgtcatgaatgggattggtgcccttattaaacagacccaagagaggtcccttgtcccttctactgtgtgaggactcagaaggtggtgtctatgaagaagcaggccctcaccagacaccaacatgtctgctgccccttgatctgggaccttgcagcctctagaactctgaaaaatcgatgtttgttgttttataagccactcagttggtggcattttgttagagtagcctgaacacggactaagtcaaacagaagaacccacaaaccagctacagagttgggcatttggagaaattcaaaaatgagtcagacataactccttattcttgaggtgccctaagagatgggacacagcagctgcccaggtgcattagtttgttctcacattgctataaagaaatacctgagactgggtaactcataaagaaagaggttgaattggctcacagttgcacaggctggacaggaagcatggtgctggcatctgctcagcttctggggaggcctcaggaaacttacaatcatggcagaaggtgaacgggaagcatgcacatcccatgactggagcaggagtgagagagagagggaaatagagggaaggtgccatacacttttaaacaaccagatctcatgagaacacattcactatcaagagaacagcaccagtggggaaatccgcccccatgatccaatcacctcccatcaggctccgcctccaacactgggaattacaatttgacatgagatgtgggcagggacacagatccaaaccatatgaccagattaatacgatttgaggcatcacgaggtcattaaagagagggaataaaagactggggctccaggaagaaggctctggaatccagcagagggtcaaggaccagcttgtaaagctggtggtgcctgagaagtacctaggagaacatagatgctgtgacgtttgatgtagctgttttttgttttgtgttttggtttttgagacagagtctcactctgttgcccaggctggagtgtgcagtggcgtgatcttggctcactggagcctccatctcccaggttcaaatgatcctcatgcctcagcctcctgagttgctgggattacaggtgcacaccaccacgcctggctaatttttgtgttttcagtagagacagggtttcaccatgttggccaggctggtcttgaactcctgacctcaagtgatccaacaacttcagcctcccaaagtgctgggatgacaggcatgagccaccatgcccagcctgatgtagctgtttctgtgcacattatttgctgtggggtatattcagatttcttaatacaagatgattctttgcctcatgacttacacaccattttctatttaatttcagctatgatattggaaatggacatgtcttttcaaggaaaataaaagcaggctttctggaatggcgacttccaaacatatttgtcaatttaaaggagctgggagtggggaccctatgctccgtaagcactctcttagctgttcttggctgtgctccccgcttcagcttcacactgcccttgctgtgaagggagcagcctgggccgggcgcggtggcttacacctgtaatcctagcactttgggaggccgaggtgggtggatcacctgaggtcaggagttcaagaccagcctggccaacatggtgaaactccatctctactaaaaatacaaaaaattagctgggcatggtggcaggtgcctgtaatcccagctacttgggaggctgaggcagaagaatcgcttgaacccaggaggcggaggttgcagtgagccgagattgcgccattgcactccagcctgggggcaacaagagcaaaactctgtctggaaaaaaaagaaaggagcagcttggcaaaccccaccttgtcgcttttgtgagtgcctctgaccctttggctgccaggacgggcgtattttatggaaatgctaagcaccaacagagtaaagtggtttggtttttcacagtggtgggagataatagctccaaattgtctttttcagcactgagtgaagaaatgaaagacaaaggtggatacatgagcaagatttgcaacttgctacccattaggataatgtcttatgtaatgctgccctgtaccctgcctgtggaatctgccattgcgattgtccagaggtgagcattttaggtggctccgtgtcttcctcacagggttgatatgaggatgaaacaagatgatagatcatggtggcatgtagtctgggacctggattgtcgtgccacagatcacagctcacagtctatgtgcaatgcccctgaatgttgcccacctgtcctcaagccacacatgcacctgtaactcagtgcaagcccagaaactccccgtggggactcctagagctgtcagtggcctcacatagcagctggtccagtctcttgtgattgcccaaggaaactgaggcctggagagcttggggtcactgctctgaggccatagagatgcctagtagaagggccaggcctagaagcaggatccttgctgcccctctgagctgtttccatttaaaatcacatgaaggccggcgccgtggctcacggctgtaatcccagcattttgggaggccaaggtgggtggatcatgtgaggtcaggagtttgagaccagcttggccaacatggtgaaatgccatctgtactaaaaatacaaaaattagtggagcatggtggcacgtgcctgtactcccagctacttggaaggctggggcagaagaatcgcttgagcctgggaggcagaggttgtagtgagccaagattgtaccactgcactccagcctgggtgacaggagagaaaccctatctcaaaataaaatgaaaggtaatgaaatgaataaaataataaatcaagtcacggccgggcacggtggctcacacctgtaatcccagcgctttgggaggccgaggtgggtggataatgaggtcaggagttcaagaccagcctggccaacatggtgaaaccatgtctctactaaaaatacaaaaattagctgggcatggtggtgcatgcctgtaatcccagctactccggaggctaaggcaggagaattgcttgaagcaggacctaggaggcggaggttggttgcagtgagccgagatcatgccactgcactctagcctgggctacagagcgaaactccgactcaaaaaaaaaaaaaaaaaaaaatcaaatcacatgaaagtagaacatagggaattccatctttcgttctaggcatagtttgttaatatgattcagagccagcagttaggagaacacagtgtgactctcctagaacttcttgattgggcttcctctgattgggtttcctctgattgggcttcctctgaaagtgggggggatggggggtggggagcagaatggtcagagcttggctcagcagtcagactgctcttcttcaaatcctggctgcattgcttactacagctgtgtgactccagatgactgaatccacctctctgtgctgcagcttcccgtctagagagatcacctggagcagagggtggtcaggagactcaatctggttactgactcacagtgcaggagtactcatcccatagtaagcatccagctagagatgttgatttctattttcaggtaataatgatgatcgtaaaattagagacagataaaaggtatgggcattaggccagggcactgcaatttctaagctgtgtgacctcaggcaagttactcgacttctctgagcctcagcggtttcatccgcaatatatggataggaaaaccgacctcagtgggttgtctgacagtggagggcacttgattaaaaaaaaaaaaattaccctggtctgaatattaccctggactgaaagaaaaatattgagctaatacaggcatcaggaatggggctgcagggagtccagggaagggagaacgaagagcctgaaggtgtgaggaggtgcgagtgctgatctgtctgctacaaagaggctgctgagcctcctgtggatgtggccctggacttggcagtttaatacctgagctgttaaaataacctcagatgctgtgttctttaaggggtaggattcagattcctgctgaaatgcttctgaaagggagggaatgagccagcccatccccagttgctttttaagatcattgggaagttctggtcttgccatttgtccctggaccactcttaggtcctcctgccccacttccatctgggtgtgtgccctgggctgtccaccacacagctacatcctgccatcttccctcctggagccactgtgccatgcatggatctgtagcttcatttttcttggcttttccctggtttttctggagcagagtctctagtaaactcccaaggaagaaaacgtttgactttatgtgtgttgggaaacgtgctttttttctattacatctcagtgataggttggccatgtctagaattgcaggttgaaaatcatttcctctcagtatattggttagtgagaagcctgggactgagacagtcacattctcacttctttgcaggtgagtgctcttaggactgtctttttatcccttatactctgaaatgtcatatgtcttggtgtaagtccttatttcagttattgagctggacaagtactggagaccccttcagtcaaagccttctgtcattctccagctctaggaaattatcttctattgttatttctgttattccttcccttccattttcttttttctttttttttttttttttttgagacagggtcttactctggtgcccaggctggaatgcagtgacctgatcatggtacactgcagcctgaacctcccagactcaagtgatcctcccacctcaacctcctaagtagctgggactgcaagcacacatcaccacacccaacaaatattttttaaaaattttgtaagatgggatcttactatgttgcccagactttttcttcctcttcctggggctcttattaggaagatgtttgacttcctgggttggattcctgtctccgtgtctgactttctctctttgtcatatttttcatcactcgttgtctttttgcgtctgctctgacagatttcctcaaattttgtcttctagtcctatcctacagtttttactttcagcaaatataatttaatctccaagagtactctcttgttcttttttcttagcattctgttcttgttttatggatgtaacattctcttggaatatttgctgtcctctagatcatcccttctccatttcttcttgggctagtttttctgtttcttcatctttctcttttatgctacttattctgggcgtgttcttggtgggttttttcccatatagcaacagaggacttggagctcagggagaaaagggtaggtgcatcacctggcagagctcccagacagtgacaggcaggctgcgggaaggatgtctacttggcggtgctaccgctttcctagaaaccctttccctggagctggttgaactgttgggttttgccctggtggtgaacgctggctccccgtgctctgcctgtttcatcaccagccccctccccttctgcctggggtccagtaatctgttgaaatatatatcttgctcattggtgagctcctgctccttcctcgttgctcttgcagatttatcacttctcgtaaggctgcgcttgtacttcgggattttctctgtgccacactgggaaacatagggtggttgcatgctgcagtcctgagcacttatttcactcacatctttacacgaagatttggtgggtgtttactttgtttttagtaagttagtctgtcatgtcctttgatcctttttttttgttttttgagatggagtctctctgtgtcctccaggctggagtgcaatgtcgcgatctcagctcactgcaacctccacctcctgggctcaagagattctcctgcttcagtctcctgagtagctgggattacaggcatgtgccaccacacctggctaatttttgtatttttagtagaggtggggtttggcatgttggccagcctggtctcaaactcctgacctcctgacctgcctgccttggcctcccaaagtgctgggattacaggtgtgagccaccacacctggccctgattaatcttttaatgcccagtctctccttcaaaagccggctcctttctctccctcgccttcctagattccttctccactccccaggatcagcctcctcctccccaccccaccactgccggggggatgtctgtggtcaggcatttatcagagaccctgaggtgggggtcctttatgtgtctgggggatggagagtctagaggaggtagcgttcagacctctccatggtgcctctgctgggctcacatgtgaccaagcacagcaaaccatgaggcaggggatggtcttgaccatgagagcccttgcagcagctgccatgggcctcagctcctctccaagctgggaagagccctgaaaagccaaggtgtttttttttccctctttatttcagtgtaagtcccttgagctttcttgaaccagaagtgggctcattttgctttagagatttcaggtgggcttgtccttgtcctagcatcccagatccaccttctgggaagtcatcagattggaggtgatgttggcagcttttgtaaacaaagggtagtgttgtaagctgttgtgtctgcctatgtgtgtgtttgtgtacttggtctcatctctgcagactggtgacatggcttccagatatgcccgacgatgtcctgtggttgcagtgggtgacctcacaggtgttcactcgagtgctgatgtgtctgctccccgcctccaggtaaatactttggctgtgggtgtgtgggccggacgggcacctctctcatctgatgaggcctcacacgacattctagaaacagctggctgaacaccaagcaaggagcttgcccttgggtgtggggaccctgtctcatgggaggcagctgagtcagtcagaggtcctggcacacctgctgagagctgccacccaggccaacctgaaccggagcctgggaagacttcccgtcggatgagtctctttgagtgcagcattgatggtggaagagcagagaggccccagataagcagggaaaggtgcttcagacagagtggctgggatgaggactggggagtgtcagatagcgctggcgtgtctgagcgaaggagctctggcacccatggcacaggaaggaggtgggaccctggaggggcagggctagcagagctcctcggagcgtgtggctaggtgcctggtaatgcaagccccctgtcctccaccctctgttgtactgagtcacagtctccggggtgaagcctagcagtctgcgttgacaggccccaggggatgccgctacttcctgaattctgaattctggaaactgagccggagttcagggcctggctcccattaccagggttgggcgttatcctgaaaatcataggccttggtttcctcacttggctaacaggggtgatccccatcccctcaatgggtttccgtgagctcctgagagcccgtagcatggtacttggcacatgctgggcatcaggaggtatggcctctcttgctattgttgttattggtagacacagaaggatttaaaagtaggggaatgcaaagatccgatttgctagggaagagggcagtagtggccaagtagagggtggatcctgggccctggctggcagcaggcagcaaggggggctgccagggcccaggcagggacgatctgtagaccgagaggcttcctaaggctcttggacaggaggaggtgtcggttccaagcctaaggagtggggcagccctggtgactggtggtcagtggtgccaggcggtgggtggtaggacaccctggcaggcaagtaggtttgtgtgggggaaactgataggcccctccagggattcgttggtggacaacacctgtgatgtccagtgggaggtgtccaggtagctgggagggccacaggcttggaagacctaggtggtgacatcagcccagcactgagggctagaagaagctgtgtctctggctgtgacggcaccctagagtgtgtgtggtgccctctactggccggcaatgtgggtccaccgtagctcagactgcacactgcagcagcgggaacggcctctaagccaacttcctccatgtgtttcaggtcccaaatgccagtgagcagccaacaggcctccccatgcacacctgagcaggactggccctgctggactccctgctcccccaagggctgtccagcagagaccaaagcagaggccaccccgcggtccatcctcaggtccagcctgaacttcttcttgggcaataaagtacctgctggtgctgaggggctctccacctttcccagtttttcactagagaagagtctgtgagtcacttgaggaggcgagtctagcagattctttcagaggtgctaaagtttcccatctttgtgcagctacctccgcattgctgtgtagtgacccctgcctgtgacgtggaggatcccagcctctgagctgagttggttttatgaaaagctaggaagcaacctttcgcctgtgcagcggtccagcacttaactctaatacatcagcatgcgttaattcagctggttgggaaatgacaccaggaagcccagtgcagagggtcccttactgactgtttcgtggccctattaatggtcagactgttccagcatgaggttcttagaatgacaggtgtttggatgggtgggggccttgtgatggggggtaggctggcccatgtgtgatcttgtggggtggagggaagagaatagcatgatcccacttccccatgctgtgggaaggggtgcagttcgtccccaagaacgacactgcctgtcaggtggtctgcaaagatgataaccttgactactaaaaacgtctccatggcgggggtaacaagatgataatctacttaattttagaacacctttttcacctaactaaaataatgtttaaagagttttgtataaaaatgtaaggaagcgttgttacctgttgaattttgtattatgtgaatcagtgagatgttagtagaataagccttaaaaaaaaaaaaatcggttgggtgcagtggcacacggctgtaatcccagcactttgggaggccaaggttggcagatcacctgaggtcaggagttcaagaccagtctggccaacatagcaaaaccctgtctctactaaaaatacaaaaattatctgggcatggtggtgcatgcctgtaatcccagctattcggaaggctgaggcaggagaatcacttgaacccaggaggcggaggttgcggtgagctgagattgcaccatttcattccagcctgggcaacatgagtgaaagtctgactcaaaaaaaaaaaatttaaaaaacaaaataatctagtgtgcagggcattcacctcagccccccaggcaggagccaagcacagcaggagcttccgcctcctctccactggagcacacaacttgaacctggcttattttctgcagggaccagccccacatggtcagtgagtttctccccatgtgtggcgatgagagagtgtagaaataaagac

SEQ ID NO: 43 - DNA, 23830 bp, Homo sapiens
atggtccgaggggggcggggctgacgtcgcgctgggaatgccctggccgagacactgaggcagggtagagagcgcttgcgggcgccgggcggagctgctgcggatcaggacccgagccgattcccgatcccgacccagatcctaacccgcgcccccgccccgccgccgccgccatgtacgacgcagagcgcggctggagcttgtccttcgcgggctgcggcttcctgggcttctaccacgtcggggcgacccgctgcctgagcgagcacgccccgcacctcctccgcgacgcgcgcatgttgttcggcgcttcggccggggcgttgcactgcgtcggcgtcctctccggtatcccgctgggtgcgtctggggacgctgcccgggctccacgtgcggagtgggtgccccctaggccggggagcgggggatccccaggggtcgcggggccctggaggagcgggcatcggacgcggacacggcggggtgcatcccgagggccccctccgaggcagatgcttcctgcgggggcgctgttcctgggcccgggaagggggcgttggaaccccgagcggtccgggccgaagcctgggactctcgtgcgtccccacccctacccccatcaggcgcccgtgcatgaagggagaccctcacctccggactgagagtcggagcgtctcggagcgacggggagtagggagcgggacccggggcggagggtagtgctggcccctgcggactccgggtcccctgtgtcctctcgggaggggctggacgggctgagctgccgaggggccgatttgccctgggccggacaaagagtggggctttggccggtcccccacggtgggctccttccctctggggattgagggactcaagacaccccgcgcctgcgcttttcttttctttttttctttttttttttttgagacggagtttcgctcagtcgcccaggctggagtgcagtggcgtgatctcaactcactgcaagctccacctcccaggttcacgccattctcctgcctcagcctcccgagtagctgggactacaggcgccagccaccaagcccggctaattttttgtattttttagtagagacggggtttcaccgtgttagccaggatggtctcgatctcctgacctcgtgatctgcccacctcggcctcccagaatgctggggttacaggcgtgagccactgctccctgctgcctacgctctctgggtcgcagcccagccttctgggggctgggtagcctcccagaagggcaaccctgggcatcctccagggcaggctaactggagtctagtggggaggggtaccttgaaagaggaaagttgtttcctcctcctcctcctcctccagtgtttgggacccttcctgggggctggagtgcatccctggacaccccccaatcccatcctcttctctagtttccactgacctaggcccaccctcccctctccggctcagtactcctggaaatgagattccgtacatttgaatcttgtcctaatgaaatatttgtccatgtgggtacctgtgtgtgtgtggtgggggtgcagacggagggtttgtttctcactagctggaactactggggtgtggtatgcttcctgggaatttgtgtgccacagtcctggaggcgaggagggggttgtgagccagtaggcaggggctggggcaagtagcattgtgaagctattgacacccagacgtccccaggcaggagattatgcccccattagcccccttttatctgggcttccttaacaatggactctttgccctgcctgccagagccagcagggagtgactgttcagtggtgaggaagcgggcagaggaagccctgccattgggtaggagcagtgggcagcccctgggctgactgggaggtggggattagggattagacagtcctggctgtctgccttcccctaagccagggggagaggagcaaagggcacgaaatgtggcctccaggaggattagaccgccacatgatcatttgcacaccctggggtttagcaacaataaaagtcagcttttttgtatcccaaggtggcctgtggacacccacatggacaaatgtttacactgggacagaattcaaatgcagaggtcccaggagcctaaagtacactcactctggtatagaaaggattccttactgggcagaggacaggtgcagcctggggctttcccaggcaggacacagggaggctcaggaaccaccaagtccctggaaggtggatctggaggcgttggcaggagccactccctgggttccagggctccaggttcctgctttaaccccctgtctcacagagggctgtgcacttgggggctgctgagcatgtcccagaggctgcatcctggacacagcacctcagtgcatctgagctgaggctaacttggcaggagggacaggcagaacctgccagccacgtgcaattccacccctctggccactcagggaaggagagctgtgagtcaagatcagatttgggtcaggacaggctggggcctgcctgtccctgtgcatcccaagatttatggctggccaggggttgggctgggaggggtggtcttgcatgccaggagagtgcagatcagcctgagaggccaggccagtaagtgaggtcagatctcctgcacctgatagcattaaggccatctacaccaaagctctaatgctgatatgttcctggcctctatgtggggcatggaggtggggcatggaggtgaggcctgctcgcctgggcttctggaagtgggagactcattcctgtggctgaggcctacagcagtgctgtgtggtaggaatacactggaagccatgatgtcattgtgcattttctagaagccacattgaataaagtaaaagacacaggtagaattaatttcattgagcccaatatatccaaaataatatcattttcacatctattcaatataaaaatttactaatgagatatttcatactaagccactgaaatccagtttgtatcttacacatctcagttttgacgagccacatttcaagggcgtgatagccacatgtggctcccatagtagacagtactggtctagagaaatgttggtggcatccttgctgtctggtttctggccttgccaaaagtattaccatcccagtgtggtacattctttcatgtatttgtctcctgtccccagagcagactctgcaggtcctctcagatcttgtgcggaaggccaggagtcggaacattggcatcttccatccatccttcaacttaagcaagttcctccgacagggtctctgcaaatgcctcccggccaatgtccaccagctcatctccggcaaaataggcatctctcttaccagagtgtctgatggggaaaacgttctggtgtctgactttcggtccaaagacgaagtcgtggatgtaagcagtttgcttatctggacgttgtcaagttagaaaagctgttttgggatgggtgtggtggctcatgcctgtcatcccggcactttgggaggccgaagcgggtgggttgcttgagcccaggagctcgagaccaacatgatgaaacccagtctctacaaaaattacagaaaaattagctaggcatggtgttgtgggcccatagtcccagctactagggaggctgaggcaggagaattgcttgagcctgggaggtggaggttgcagtaagtcatgatcatgccactgtactccagcccgggtgacagtgagatgctgtctggaaaaaaaaaaaaaagaaagactgttttgttttggaagcaacacaggcagttgtaggccccctgtgccagagtgacataaactctgtacacctccagtgatttggtccatgtttgtaaaccctgaatgttccagggcagtttcttttcttcactttttatctcttttttttgggtgggggggcggggtacagagtcttgctctgtctcccaggctggagtgcagtggcgcaatctcaacctcccgaggagctgggactacaggcacaggccatcacaccttgctaatgtttgtactttttgtagagacggggttttgccctgttgcccaggctggtcccaaactcctgcacccaagtaatctgcccacctctgcctggcagttacaatttcaaataattcctccctttccttcaacacttggctcatgaccgtccagtccaaggaacctgtcctgcaggtgtgcctctcccgagcttcctctatgcatcttccataatgaagatgccttctcactggaaaccctacaagggtgggaacgtgccttatttgcctgtatcctcagggtctagcagagagaagataatttgtaataccaaaacaccattaaattcagctgatgctttcataagcgctccttggaggaaggactccatttacttgacagatctgtgcaagacagcagcctggcgcgtctaacctgcagccagttgcatcctctgtttaaccttgtttgcggaagctttctctaaacagccagcacttgtctgttcccacatgggtccgttctcccagtgaatcaccgtggtgcctgctgactgctctgtagcacagtgcttcgcaaagtgtgatcctgggaccagcagagcagcagctcctttgagcttattggaatggcagaccctcaggtcccacctctgacctgctgcatgggaattctggggagggacgcagaatctctggttccacaggctctccggtgatgctaatgaataccggcatttgaacagcaccgatctagcccctttcagtccatgagccaacaacccttggtcctgtctgtggtgacccagtgtgactctcatggggagcaaggagaggaagttgaagttcactgacagggttgttaaggggattatgcaatagatgagacccatgggcctgaagtccgagggtgtatgttagttccccgttcttttgacccatggattaacctactctgtgcaaagggcattttcaagtttgttgccctgctcacttggagaaagcttatgaaggatcaggaaaattaaaagggtgctctcgcctataacttctctctcctttgctttcacaggccttggtatgttcctgcttcatgcccttctacagtggccttatccctccttccttcagaggcgtggtaagtcggctttctctgctagcgctgagtcctgggggcctctgaagtgtgctcacacatctcctgcctgcagggcactggtgtcgggcacctcagggtctgtcccatggtggagccccatgcctcactgcctttcagacagagtagccacagctggccctatttccaggctacccgggcagcaaaacttactgcatgtgtaattaattatttggctatctgtaaggtaaactggctggttcacttaatctgcaccttaagcatcagatagcttctcagtgatctagttaaactatatgatgttggccaggcgcggtggctcatgtctgtaatcccagcactttgggagcctgaagcaggcagatcacttgaggtcaggagttcgagaccagcctggccaacagtgtgaaactctgtctctcctaaaaatacaaaaattagctgggcatggtggtgtgcacctgtaatcccagctgctcgggaggctgaggcaggagaattgcttgaacttgggaggcggaagttgcagtgagccaagatcgcaccactgcactccatcctgggtgacagagcgagactctatctcaaaaagaaaaaaaaaaaaaaggtaaataaagtatatgacactgaagaatctgttacccctggaaggtggagctttactcttagggggaactataacagtcatatatatatatttttttcttttctttttttttttttttgagatggagtctggctctgtcgcccaggctggagtgcagtggtgcaatctcggctcactgcaacctccacctcacaggttcaggcaattctcctgcctcaacctcccgagtagctgggattacaggtgcctgccgtcacgccaagctaatttttgtatttttagtagagacagggtttcatcatattggccaggctggtctccaactcctgacctcaggtgatccgcccgccttggcctcccaaagtgctgagattacaggcgtgagccatggtgcccggccaacaatcacatgtgttgtaaacaacaacaaaaatctgtcagcctggtctaacctagatttgtgctttgttttgttttgccactttgtgatgcacaggaggaagtttaggctgtaaaatactagccttttagggtaatttttgaactcacaagagcagcagcggaacctttgatgcaatcctgtatgtagcaccagcagagccacgtggcagagggactcgcattaggagcctcccattacagactacgtgctcctgtgcgttatcttatagggtccccacaaccaaggggagatgtgattattcatcctgtgtggctgtggggaacttgagagtcatacttgcccaaagagcacggccagcgagcttgcacccaggtcactctctgctcctctgtcagaacagggcatgtcttggttcactgcagggcggctcttctcattctctgtagtttggggtccaggatagtggtccacggagccactggagtgcccagctactgagtgaccaaagcatattttggatttccgacattgccacagcatggttgggcatcagcaggaccccaaccccttgttatgctggtggctttatgtggttatttgatcttccccagaactcagcaggagtgcacccagcagcaccgtagtgatgctctctggctccccagtgcacggttctggctttccttcctggtcgagagtttcaagccctctgggtcctactctgtccttttcagcccatagctttgttcaaaagctgctggcagtgttcagatttggctgagttcagtgaatatgtgcattggctgatttctgagccatgccagggggatggagaagccgaagcaggagtgtttgttctgcaggctctggagtaggcattgggtctgtgccggctcacttgctagtcttgcatccttccccaaccccctctggggatgtctggccacatcagaagacagtttgggttgtcagaactgggggagtaccaggccgaggtgggtggatcatgaggtcaggagatcgagaccatcctggctaacacagtgaaacctcatctctactaaacatacgaaaaaaattagctgggcgtggtggcgggcgcctgtagtcccagctactcgggaggctgaggcaggagaatggtgtgaacccggggggcggagcttgcagtgagctgagatcctgccactgcactccagcctgggcaacaaagcgagactccgtctcacaaacaaaacaaaacaaaacaaaacaaaatctgggggagtgccactggcatctgatgtatagaggcccgagatgctgtgtcatcacccgttgagtgcgctcataggcatcttcctgacaattagaacccattattcttcaaattcaatgcaagcaaattcaaagcattactgtgtacataccgcatgctaatcaattgcaccactggagctcctaaattcaaaacattactataaaaaagttcaaaatgcatggaaaagttgtacatggcaggagaatatttgggcttctgactaccccttgaatgaagatgatccaccagccgccttcctccttggtcttcactccagattcctagcatttcattctgtgtctctttatgcagtgaggtttttgtttgttttttgagacagagtctcactgtatcacctaggcctggagtgcagtggcgcgatctcagctcactgcaaccctcggctcctgggtttaagcgattctcctgcctcagcctcccgagcagctgagattacaagcacacatccccatgcccagctaatttttgtatttttagcagagacagggtttcaccatgttgcccaggctggtctcgaactcctggcctcaagtgatccatgtgcctcagccttccaaagtgctgggattacaggcgtgagccaccatgcccagctcctagtgaggtttttgatgccttgctacatctgccctagaaattgtgtgactacgattttggaaatgttgctgtgtaaacttgtgatcatttctggactccaggcaagaatcttgatggctaaggtgtggctgaacatgtctgattctctcctggacctgttttaggccaaactctgctctgaaattcctccgtgtggaagggcgggctggggagagcctcccagctggaatcttttggatgcctttctctgtgggtatctgatggctggctctgatggctggctgtgatggctgtggctggaaatcattgttgacatgagtttcacagatgcaggctctgtccaaattgtagcaaaagctgcctgccccagccgagctatgggcaataaggtggtttaaggatatagatgaaggaaaactcacccttagaataatttatccaaaatgctgctgtgttgtgggttagaggacattttctgaggtcccaggttcattgtttcatttaagtctcaaaagtccctccaggtgttggttctaattgtcaaagcatggggggagatgggctcatgggttaaaggtcttatcccagatttctgtatcctccttgcaagcagcaaaggggtctggatttgaatccatgaccatgtttctcctttgggtttccatcacactctgtccccgtgcactgagcaccctttagttcatatgacccccttaggcatgttacatgggcactcctataggtgcccatctggccctaggacttggccaacacaacatggactccagtttccatctgcctctttgccaggcacttttgtgcagtgcacacactgtacaacagtagacggcaaccctgagagccagagtagagcctgtcctagcaccggaatgctcggtaaggatttgtcgcaggagtgattccaaagccaatgtcctccctccatatcagcctgtttgtggctctgagaagctctgcccacatgtgaaagcttgttaagcacttaagcactaacccagagcttcagacagtgccagtcctttttccccttctttaaaagcgatatgtggatggaggagtgagtgacaacgtacccttcattgatgccaaaacaaccatcaccgtgtcccccttctatggggagtacgacatctgccctaaagtcaagtccacgaactttcttcatgtggacatcaccaagctcagtctacgcctctgcacagggaacctctaccttctctcgagagcttttgtccccccggatctcaaggtgagttggtggtgagggggcaggtgttctggggtgcagctcttctttgcctccctgattgccaggagctaccagttactgtctgcacaatcaaacagaaatagacctgtccttgatggttaacggaaataaaaggcgcttgtcccagaagctcaggtgaggcaccaccctgattatgggaatcacctgggaacatatacccagacctaaaactcagatccacttcccaggctgtggttatatagtcaggggggtgcagtatgggtattaggattttttattttttagttataaagatttttttttggtttgtttttgagacagggtcttgctctgccgcttaggctggagtgcagtggtgcaatcatagctcactgaagcctcagactcctgggttcaagcagtcctcccacctcagcctcctaaggagctgggacccacaggcatgcagcaccacacctggctaatttttaaaaattttgtggagtgttgcccaggctggtctcacactcctggcctcaagcgatcctcccaccccagcctcccaatgtgttgggattacaggcatgagccattgtacccagccactaagatgattcttatttggaaacacggtcaagaacaactgcgttcggtagtttaaccttttttgattgtggtggttttagtatgccttaccactctaccatagtaagaaatttgcagaccatgtacaccaacctttggtgctcctggggagaaagaaagaaggctatgcaatgcaatgcatgctcacagtccaagggagagggaaagctgtctaacaggattggttttcccgtgtgctttataagcagatgagtagaggagacagctcttattgtcctagtggcaattgggataggctgcaaagtttgttagggtggaggcttattccgggaccaagggagcccaaagaaacaagctcctgccaggcgcggtggctcacgcctgtaatcccagcactttgggaggctgaggcaggtggatcacctgaggtcaggagtttgagaccagcctggccaacatggtgaaaccccgtctccatgaaaaatacaaaaattacccgggcatggtggcgggcacctgtaatcccagctactagggaggctgaggcaggaaaatggcttgaacctcggaagtggaggtggccgttagccgagatcacgccactgcactccagcctgggcaacagagcaagactctgccttaaaaaaaaaaaaaaaaaaaagaaaagtaaaaggaaaaaaaagaggctctggcctgctggggtgcctgcaaagtctccgtggaagggtgacattcaagccgagacctccagggaactgtctcctgggagcacagagccctttgctcagcccccaggtggctcagtgcccccagccagcagactcagagcttgcatgattctttggtgctctctgcggtcttccaatgatgctgaaataaatggtgcttggtgtctccctgctgtagtccccttgcttgctttgctcacaggtgctgggagagatatgccttcgaggatatttggatgcattcaggttcttggaagagaagggtatgtatgggctgggaggatcagccatgcccttttgacaagcatttactagcggtcttggtaaagacttgagatttgccttagttctaacacttagtgcccaacgccttccttgtgttgctcaacctactcatgagcccaggagataggaaatctccgtcccattgtacagatggggaaacagaattttggaaaggagagccaagcagcacacacccctccctgaggggcagagccgagatttgaactgggatgtcatgactccagggccctctccctccccagggtccccttatctgaaggcggtttttctttccagctcgacctcttgtgacccttagtttaacaagggccgaagttaaagagtttctgcgcctggaccccaaatgaagcaatcagatttctcatctccagtcaggtgtgggtccaagcccactagacaagtttgctcttcccagagcacatttctgccttcaagtcatcctggcttgtcagggctgggggagttctgctgtagaaatattagagtggaaggaaaaagatgtgttgggagctatttttctttaatactaaaagttggttgatgaatttgtcgttggccaagaccaaggagactgcatttttaaggacatatgtgtatttatctgctcagaaaatgttcattgctgtgtgctagggatactgcagtgaacacagaggtgtgacccttgccagccttgtgagagaagtgagcagataagtaagcagaagggtgatgctgtgtcgatgggaaagtacaggtgccaatgagaaggcacaggtgtcaaggagaagacacaggatgctggaggctcatgcaggatggatctccaaggcccaggggaagaagggcctctcggaggacgtgaatccacattaagactttggggataagtaggagcgccttaggcatggggacccatggatgcgaggcctgtaggacacagacaggatggcatgaaggcctgtgcaactggaggggtggggatggggacactaagagatggctggaagtgtgggggtggggacactaagagatgactggagaagagggggtcaggagtggtgaaaaatgggagaggagggcaggctgggccttttggatacagggggattgcatcctgcagtggtagggagccactgagggctgctgcagtaggagtgaggggatcagaggagagctttggaagccccctggatgcgggacaggaagcgagataccagtgtctaggaggccagtgaggcagccacaggctccaccaggatcagggctgcgagggtcatgaggaggaaaccaatttgaaggagtccaggggaataggacttggaaatgaccgatgggacatttgggaagaggaagacagaagagcgcagtcccggcttctggctttagcagttgggcaaggggagatggggagatgtgcccatgggttgagggttgaggacattaggagggagccggtatggcaggaagagctggtgtgccagagatgctggaagcagcatctgcctgagaacagatacctggcaatattcctaagggaaagtgacatctcggagggtgaggagggcatctgatagggcctggaaagagccggggcaagcatgaatgtgaggttatcttggggggcaaggctcaggcgttgaggagcagcccctggtctcttcagcctgaagttggaagccagagttgggccaggtgcagctgtggttgtctgaagtccccctcccccagcccagtgtgccaatgctgtaagagcaagggccgctcactggtgctggtggctgagtcccagcacccaggacagggcctggcacatactggtgcccaatcctcccttctgggtgcttcttccaaggccttgtgatggaagtgagtaccctcttcgacatcagacccagcttcaaatcctggctctgctatgtattggctgcgtggctttagacaagtcttttaaccttgctgtgcttctgatttctcagctgaaaaatggagatgatgatagtggtttctgtaaggccttatggtgaagcacctagctcagggcctggaaggcaggtgtaaccagtggttcagttgttataaaccaacactaaccctcgcctttgcacctcatgaaaccagatatgtagatggagcccacaaagctagcaggagccaagctcacgtgtgtcctgctttaaagccccatacccctttctccgggtgacaaacacctgtgctcgttctcttcccttcccctcttccccttgcatttggctaataacaggccagctgcctgcctccctgcagtttggtagatgggtgggtaacgaccaccactcccacgttcgcctgatgggcttgttttccgtgcccttcacaggcatctgcaacaggccccagccaggcctgaagtcatcctcagaagggatggatcctgaggtcgccatgcccagctgggcaaacatgagtctggattcttccccggagtcggctgccttggctgtgaggctggagggagatgagctgctagaccacctgcgtctcagcatcctgccctgggatgagagcatcctggacaccctctcgcccaggctcgctacaggtacccactcctcggggtgagcacgggcagcaccttgttttctttcttgtgcattatggaggaagatggtactgccacatgggagcgatagggtgaggcaaccatgacaggtggttgggaacatctccttccatgtgtacagcctgggctgctgccatcactcccagcacagcccccaacccccccaatcctggaaccttgccaagtctcccttcccatggggtcatgaccaggaggaaaacaaactccagctgagccccttggggttccccatataggctcctgcctgtggcagctgggccctctgtacccctttccaactctgtctccctaacatggcacctgagctcctgccatcctggatttcatggaccccaaggatgggggtcctgcatctgggacttggcctattactcggagctccttttcagccgcctccctccacctgtccacccacctcaaggctcctttcttgagacctctcctaatttctcccttcccctaaacccacaattttgaacctccatcgaatggtgctgtattttataatgtcatcaaatatcaaatggagacagtgctatggtccaaatgattgtgtaccccccagaatttgtcttttgaaatcctaacccccaacatgatggtcttaggaggtggggcctttgggaggagattaggtcatgaggaaagggctgtcatgaatgggattggtgcccttattaaacagacccaagagaggtcccttgtcccttctactgtgtgaggactcagaaggtggtgtctatgaagaagcaggccctcaccagacaccaacatgtctgctgccccttgatctgggaccttgcagcctctagaactctgaaaaatcgatgtttgttgttttataagccactcagttggtggcattttgttagagtagcctgaacacggactaagtcaaacagaagaacccacaaaccagctacagagttgggcatttggagaaattcaaaaatgagtcagacataactccttattcttgaggtgccctaagagatgggacacagcagctgcccaggtgcattagtttgttctcacattgctataaagaaatacctgagactgggtaactcataaagaaagaggttgaattggctcacagttgcacaggctggacaggaagcatggtgctggcatctgctcagcttctggggaggcctcaggaaacttacaatcatggcagaaggtgaacgggaagcatgcacatcccatgactggagcaggagtgagagagagagggaaatagagggaaggtgccatacacttttaaacaaccagatctcatgagaacacattcactatcaagagaacagcaccagtggggaaatccgcccccatgatccaatcacctcccatcaggctccgcctccaacactgggaattacaatttgacatgagatgtgggcagggacacagatccaaaccatatgaccagattaatacgatttgaggcatcacgaggtcattaaagagagggaataaaagactggggctccaggaagaaggctctggaatccagcagagggtcaaggaccagcttgtaaagctggtggtgcctgagaagtacctaggagaacatagatgctgtgacgtttgatgtagctgttttttgttttgtgttttggtttttgagacagagtctcactctgttgcccaggctggagtgtgcagtggcgtgatcttggctcactggagcctccatctcccaggttcaaatgatcctcatgcctcagcctcctgagttgctgggattacaggtgcacaccaccacgcctggctaatttttgtgttttcagtagagacagggtttcaccatgttggccaggctggtcttgaactcctgacctcaagtgatccaacaacttcagcctcccaaagtgctgggatgacaggcatgagccaccatgcccagcctgatgtagctgtttctgtgcacattatttgctgtggggtatattcagatttcttaatacaagatgattctttgcctcatgacttacacaccattttctatttaatttcagctatgatattggaaatggacatgtcttttcaaggaaaataaaagcaggctttctggaatggcgacttccaaacatatttgtcaatttaaaggagctgggagtggggaccctatgctccgtaagcactctcttagctgttcttggctgtgctccccgcttcagcttcacactgcccttgctgtgaagggagcagcctgggccgggcgcggtggcttacacctgtaatcctagcactttgggaggccgaggtgggtggatcacctgaggtcaggagttcaagaccagcctggccaacatggtgaaactccatctctactaaaaatacaaaaaattagctgggcatggtggcaggtgcctgtaatcccagctacttgggaggctgaggcagaagaatcgcttgaacccaggaggcggaggttgcagtgagccgagattgcgccattgcactccagcctgggggcaacaagagcaaaactctgtctggaaaaaaaagaaaggagcagcttggcaaaccccaccttgtcgcttttgtgagtgcctctgaccctttggctgccaggacgggcgtattttatggaaatgctaagcaccaacagagtaaagtggtttggtttttcacagtggtgggagataatagctccaaattgtctttttcagcactgagtgaagaaatgaaagacaaaggtggatacatgagcaagatttgcaacttgctacccattaggataatgtcttatgtaatgctgccctgtaccctgcctgtggaatctgccattgcgattgtccagaggtgagcattttaggtggctccgtgtcttcctcacagggttgatatgaggatgaaacaagatgatagatcatggtggcatgtagtctgggacctggattgtcgtgccacagatcacagctcacagtctatgtgcaatgcccctgaatgttgcccacctgtcctcaagccacacatgcacctgtaactcagtgcaagcccagaaactccccgtggggactcctagagctgtcagtggcctcacatagcagctggtccagtctcttgtgattgcccaaggaaactgaggcctggagagcttggggtcactgctctgaggccatagagatgcctagtagaagggccaggcctagaagcaggatccttgctgcccctctgagctgtttccatttaaaatcacatgaaggccggcgccgtggctcacggctgtaatcccagcattttgggaggccaaggtgggtggatcatgtgaggtcaggagtttgagaccagcttggccaacatggtgaaatgccatctgtactaaaaatacaaaaattagtggagcatggtggcacgtgcctgtactcccagctacttggaaggctggggcagaagaatcgcttgagcctgggaggcagaggttgtagtgagccaagattgtaccactgcactccagcctgggtgacaggagagaaaccctatctcaaaataaaatgaaaggtaatgaaatgaataaaataataaatcaagtcacggccgggcacggtggctcacacctgtaatcccagcgctttgggaggccgaggtgggtggataatgaggtcaggagttcaagaccagcctggccaacatggtgaaaccatgtctctactaaaaatacaaaaattagctgggcatggtggtgcatgcctgtaatcccagctactccggaggctaaggcaggagaattgcttgaagcaggacctaggaggcggaggttggttgcagtgagccgagatcatgccactgcactctagcctgggctacagagcgaaactccgactcaaaaaaaaaaaaaaaaaaaaatcaaatcacatgaaagtagaacatagggaattccatctttcgttctaggcatagtttgttaatatgattcagagccagcagttaggagaacacagtgtgactctcctagaacttcttgattgggcttcctctgattgggtttcctctgattgggcttcctctgaaagtgggggggatggggggtggggagcagaatggtcagagcttggctcagcagtcagactgctcttcttcaaatcctggctgcattgcttactacagctgtgtgactccagatgactgaatccacctctctgtgctgcagcttcccgtctagagagatcacctggagcagagggtggtcaggagactcaatctggttactgactcacagtgcaggagtactcatcccatagtaagcatccagctagagatgttgatttctattttcaggtaataatgatgatcgtaaaattagagacagataaaaggtatgggcattaggccagggcactgcaatttctaagctgtgtgacctcaggcaagttactcgacttctctgagcctcagcggtttcatccgcaatatatggataggaaaaccgacctcagtgggttgtctgacagtggagggcacttgattaaaaaaaaaaaaattaccctggtctgaatattaccctggactgaaagaaaaatattgagctaatacaggcatcaggaatggggctgcagggagtccagggaagggagaacgaagagcctgaaggtgtgaggaggtgcgagtgctgatctgtctgctacaaagaggctgctgagcctcctgtggatgtggccctggacttggcagtttaatacctgagctgttaaaataacctcagatgctgtgttctttaaggggtaggattcagattcctgctgaaatgcttctgaaagggagggaatgagccagcccatccccagttgctttttaagatcattgggaagttctggtcttgccatttgtccctggaccactcttaggtcctcctgccccacttccatctgggtgtgtgccctgggctgtccaccacacagctacatcctgccatcttccctcctggagccactgtgccatgcatggatctgtagcttcatttttcttggcttttccctggtttttctggagcagagtctctagtaaactcccaaggaagaaaacgtttgactttatgtgtgttgggaaacgtgctttttttctattacatctcagtgataggttggccatgtctagaattgcaggttgaaaatcatttcctctcagtatattggttagtgagaagcctgggactgagacagtcacattctcacttctttgcaggtgagtgctcttaggactgtctttttatcccttatactctgaaatgtcatatgtcttggtgtaagtccttatttcagttattgagctggacaagtactggagaccccttcagtcaaagccttctgtcattctccagctctaggaaattatcttctattgttatttctgttattccttcccttccattttcttttttctttttttttttttttttttgagacagggtcttactctggtgcccaggctggaatgcagtgacctgatcatggtacactgcagcctgaacctcccagactcaagtgatcctcccacctcaacctcctaagtagctgggactgcaagcacacatcaccacacccaacaaatattttttaaaaattttgtaagatgggatcttactatgttgcccagactttttcttcctcttcctggggctcttattaggaagatgtttgacttcctgggttggattcctgtctccgtgtctgactttctctctttgtcatatttttcatcactcgttgtctttttgcgtctgctctgacagatttcctcaaattttgtcttctagtcctatcctacagtttttactttcagcaaatataatttaatctccaagagtactctcttgttcttttttcttagcattctgttcttgttttatggatgtaacattctcttggaatatttgctgtcctctagatcatcccttctccatttcttcttgggctagtttttctgtttcttcatctttctcttttatgctacttattctgggcgtgttcttggtgggttttttcccatatagcaacagaggacttggagctcagggagaaaagggtaggtgcatcacctggcagagctcccagacagtgacaggcaggctgcgggaaggatgtctacttggcggtgctaccgctttcctagaaaccctttccctggagctggttgaactgttgggttttgccctggtggtgaacgctggctccccgtgctctgcctgtttcatcaccagccccctccccttctgcctggggtccagtaatctgttgaaatatatatcttgctcattggtgagctcctgctccttcctcgttgctcttgcagatttatcacttctcgtaaggctgcgcttgtacttcgggattttctctgtgccacactgggaaacatagggtggttgcatgctgcagtcctgagcacttatttcactcacatctttacacgaagatttggtgggtgtttactttgtttttagtaagttagtctgtcatgtcctttgatcctttttttttgttttttgagatggagtctctctgtgtcctccaggctggagtgcaatgtcgcgatctcagctcactgcaacctccacctcctgggctcaagagattctcctgcttcagtctcctgagtagctgggattacaggcatgtgccaccacacctggctaatttttgtatttttagtagaggtggggtttggcatgttggccagcctggtctcaaactcctgacctcctgacctgcctgccttggcctcccaaagtgctgggattacaggtgtgagccaccacacctggccctgattaatcttttaatgcccagtctctccttcaaaagccggctcctttctctccctcgccttcctagattccttctccactccccaggatcagcctcctcctccccaccccaccactgccggggggatgtctgtggtcaggcatttatcagagaccctgaggtgggggtcctttatgtgtctgggggatggagagtctagaggaggtagcgttcagacctctccatggtgcctctgctgggctcacatgtgaccaagcacagcaaaccatgaggcaggggatggtcttgaccatgagagcccttgcagcagctgccatgggcctcagctcctctccaagctgggaagagccctgaaaagccaaggtgtttttttttccctctttatttcagtgtaagtcccttgagctttcttgaaccagaagtgggctcattttgctttagagatttcaggtgggcttgtccttgtcctagcatcccagatccaccttctgggaagtcatcagattggaggtgatgttggcagcttttgtaaacaaagggtagtgttgtaagctgttgtgtctgcctatgtgtgtgtttgtgtacttggtctcatctctgcagactggtgacatggcttccagatatgcccgacgatgtcctgtggttgcagtgggtgacctcacaggtgttcactcgagtgctgatgtgtctgctccccgcctccaggtaaatactttggctgtgggtgtgtgggccggacgggcacctctctcatctgatgaggcctcacacgacattctagaaacagctggctgaacaccaagcaaggagcttgcccttgggtgtggggaccctgtctcatgggaggcagctgagtcagtcagaggtcctggcacacctgctgagagctgccacccaggccaacctgaaccggagcctgggaagacttcccgtcggatgagtctctttgagtgcagcattgatggtggaagagcagagaggccccagataagcagggaaaggtgcttcagacagagtggctgggatgaggactggggagtgtcagatagcgctggcgtgtctgagcgaaggagctctggcacccatggcacaggaaggaggtgggaccctggaggggcagggctagcagagctcctcggagcgtgtggctaggtgcctggtaatgcaagccccctgtcctccaccctctgttgtactgagtcacagtctccggggtgaagcctagcagtctgcgttgacaggccccaggggatgccgctacttcctgaattctgaattctggaaactgagccggagttcagggcctggctcccattaccagggttgggcgttatcctgaaaatcataggccttggtttcctcacttggctaacaggggtgatccccatcccctcaatgggtttccgtgagctcctgagagcccgtagcatggtacttggcacatgctgggcatcaggaggtatggcctctcttgctattgttgttattggtagacacagaaggatttaaaagtaggggaatgcaaagatccgatttgctagggaagagggcagtagtggccaagtagagggtggatcctgggccctggctggcagcaggcagcaaggggggctgccagggcccaggcagggacgatctgtagaccgagaggcttcctaaggctcttggacaggaggaggtgtcggttccaagcctaaggagtggggcagccctggtgactggtggtcagtggtgccaggcggtgggtggtaggacaccctggcaggcaagtaggtttgtgtgggggaaactgataggcccctccagggattcgttggtggacaacacctgtgatgtccagtgggaggtgtccaggtagctgggagggccacaggcttggaagacctaggtggtgacatcagcccagcactgagggctagaagaagctgtgtctctggctgtgacggcaccctagagtgtgtgtggtgccctctactggccggcaatgtgggtccaccgtagctcagactgcacactgcagcagcgggaacggcctctaagccaacttcctccatgtgtttcaggtcccaaatgccagtgagcagccaacaggcctccccatgcacacctgagcaggactggccctgctggactccctgctcccccaagggctgtccagcagagaccaaagcagaggccaccccgcggtccatcctcaggtccagcctgaacttcttcttgggcaataaagtacctgctggtgctgaggggctctccacctttcccagtttttcactagagaagagtctgtgagtcacttgaggaggcgagtctagcagattctttcagaggtgctaaagtttcccatctttgtgcagctacctccgcattgctgtgtagtgacccctgcctgtgacgtggaggatcccagcctctgagctgagttggttttatgaaaagctaggaagcaacctttcgcctgtgcagcggtccagcacttaactctaatacatcagcatgcgttaattcagctggttgggaaatgacaccaggaagcccagtgcagagggtcccttactgactgtttcgtggccctattaatggtcagactgttccagcatgaggttcttagaatgacaggtgtttggatgggtgggggccttgtgatggggggtaggctggcccatgtgtgatcttgtggggtggagggaagagaatagcatgatcccacttccccatgctgtgggaaggggtgcagttcgtccccaagaacgacactgcctgtcaggtggtctgcaaagatgataaccttgactactaaaaacgtctccatggcgggggtaacaagatgataatctacttaattttagaacacctttttcacctaactaaaataatgtttaaagagttttgtataaaaatgtaaggaagcgttgttacctgttgaattttgtattatgtgaatcagtgagatgttagtagaataagccttaaaaaaaaaaaaatcggttgggtgcagtggcacacggctgtaatcccagcactttgggaggccaaggttggcagatcacctgaggtcaggagttcaagaccagtctggccaacatagcaaaaccctgtctctactaaaaatacaaaaattatctgggcatggtggtgcatgcctgtaatcccagctattcggaaggctgaggcaggagaatcacttgaacccaggaggcggaggttgcggtgagctgagattgcaccatttcattccagcctgggcaacatgagtgaaagtctgactcaaaaaaaaaaaatttaaaaaacaaaataatctagtgtgcagggcattcacctcagccccccaggcaggagccaagcacagcaggagcttccgcctcctctccactggagcacacaacttgaacctggcttattttctgcagggaccagccccacatggtcagtgagtttctccccatgtgtggcgatgagagagtgtagaaataaagac

SEQ ID NO: 44 - RNA, 1443 nt, Homo sapiens
auguacgacgcagagcgcggcuggagcuuguccuucgcgggcugcggcuuccugggcuucuaccacgucggggcgacccgcugccugagcgagcacgccccgcaccuccuccgcgacgcgcgcauguuguucggcgcuucggccggggcguugcacugcgucggcguccucuccgguaucccgcuggagcagacucugcagguccucucagaucuugugcggaaggccaggagucggaacauuggcaucuuccauccauccuucaacuuaagcaaguuccuccgacagggucucugcaaaugccucccggccaauguccaccagcucaucuccggcaaaauaggcaucucucuuaccagagugucugauggggaaaacguucuggugucugacuuucgguccaaagacgaagucguggaugccuugguauguuccugcuucauccccuucuacaguggccuuaucccuccuuccuucagaggcgugcgauauguggauggaggagugagugacaacguacccuucauugaugccaaaacaaccaucaccgugucccccuucuauggggaguacgacaucugcccuaaagucaaguccacgaacuuucuucauguggacaucaccaagcucagucuacgccucugcacagggaaccucuaccuucucucgagagcuuuuguccccccggaucucaaggugcugggagagauaugccuucgaggauauuuggaugcauucagguucuuggaagagaagggcaucugcaacaggccccagccaggccugaagucauccucagaagggauggauccugaggucgccaugcccagcugggcaaacaugagucuggauucuuccccggagucggcugccuuggcugugaggcuggagggagaugagcugcuagaccaccugcgucucagcauccugcccugggaugagagcauccuggacacccucucgcccaggcucgcuacagcacugagugaagaaaugaaagacaaagguggauacaugagcaagauuugcaacuugcuacccauuaggauaaugucuuauguaaugcugcccuguacccugccuguggaaucugccauugcgauuguccagagacuggugacauggcuuccagauaugcccgacgauguccugugguugcagugggugaccucacagguguucacucgagugcugaugugucugcuccccgccuccaggucccaaaugccagugagcagccaacaggccuccccaugcacaccugagcaggacuggcccugcuggacucccugcucccccaagggcuguccagcagagaccaaagcagaggccaccccgcgguccauccucagguccagccugaacuucuucuugggcaauaaaguaccugcuggugcugaggggcucuccaccuuucccaguuuuucacuagagaagagucug

SEQ ID NO: 45 - RNA, 1431 nt, Homo sapiens
auguacgacgcagagcgcggcuggagcuuguccuucgcgggcugcggcuuccugggcuucuaccacgucggggcgacccgcugccugagcgagcacgccccgcaccuccuccgcgacgcgcgcauguuguucggcgcuucggccggggcguugcacugcgucggcguccucuccgagcagacucugcagguccucucagaucuugugcggaaggccaggagucggaacauuggcaucuuccauccauccuucaacuuaagcaaguuccuccgacagggucucugcaaaugccucccggccaauguccaccagcucaucuccggcaaaauaggcaucucucuuaccagagugucugauggggaaaacguucuggugucugacuuucgguccaaagacgaagucguggaugccuugguauguuccugcuucauccccuucuacaguggccuuaucccuccuuccuucagaggcgugcgauauguggauggaggagugagugacaacguacccuucauugaugccaaaacaaccaucaccgugucccccuucuauggggaguacgacaucugcccuaaagucaaguccacgaacuuucuucauguggacaucaccaagcucagucuacgccucugcacagggaaccucuaccuucucucgagagcuuuuguccccccggaucucaaggugcugggagagauaugccuucgaggauauuuggaugcauucagguucuuggaagagaagggcaucugcaacaggccccagccaggccugaagucauccucagaagggauggauccugaggucgccaugcccagcugggcaaacaugagucuggauucuuccccggagucggcugccuuggcugugaggcuggagggagaugagcugcuagaccaccugcgucucagcauccugcccugggaugagagcauccuggacacccucucgcccaggcucgcuacagcacugagugaagaaaugaaagacaaagguggauacaugagcaagauuugcaacuugcuacccauuaggauaaugucuuauguaaugcugcccuguacccugccuguggaaucugccauugcgauuguccagagacuggugacauggcuuccagauaugcccgacgauguccugugguugcagugggugaccucacagguguucacucgagugcugaugugucugcuccccgccuccaggucccaaaugccagugagcagccaacaggccuccccaugcacaccugagcaggacuggcccugcuggacucccugcucccccaagggcuguccagcagagaccaaagcagaggccaccccgcgguccauccucagguccagccugaacuucuucuugggcaauaaaguaccugcuggugcugaggggcucuccaccuuucccaguuuuucacuagagaagagucug

SEQ ID NO: 46 - RNA, 1443 nt, Homo sapiens
auguacgacgcagagcgcggcuggagcuuguccuucgcgggcugcggcuuccugggcuucuaccacgucggggcgacccgcugccugagcgagcacgccccgcaccuccuccgcgacgcgcgcauguuguucggcgcuucggccggggcguugcacugcgucggcguccucuccgguaucccgcuggagcagacucugcagguccucucagaucuugugcggaaggccaggagucggaacauuggcaucuuccauccauccuucaacuuaagcaaguuccuccgacagggucucugcaaaugccucccggccaauguccaccagcucaucuccggcaaaauaggcaucucucuuaccagagugucugauggggaaaacguucuggugucugacuuucgguccaaagacgaagucguggaugccuugguauguuccugcuucaugcccuucuacaguggccuuaucccuccuuccuucagaggcgugcgauauguggauggaggagugagugacaacguacccuucauugaugccaaaacaaccaucaccgugucccccuucuauggggaguacgacaucugcccuaaagucaaguccacgaacuuucuucauguggacaucaccaagcucagucuacgccucugcacagggaaccucuaccuucucucgagagcuuuuguccccccggaucucaaggugcugggagagauaugccuucgaggauauuuggaugcauucagguucuuggaagagaagggcaucugcaacaggccccagccaggccugaagucauccucagaagggauggauccugaggucgccaugcccagcugggcaaacaugagucuggauucuuccccggagucggcugccuuggcugugaggcuggagggagaugagcugcuagaccaccugcgucucagcauccugcccugggaugagagcauccuggacacccucucgcccaggcucgcuacagcacugagugaagaaaugaaagacaaagguggauacaugagcaagauuugcaacuugcuacccauuaggauaaugucuuauguaaugcugcccuguacccugccuguggaaucugccauugcgauuguccagagacuggugacauggcuuccagauaugcccgacgauguccugugguugcagugggugaccucacagguguucacucgagugcugaugugucugcuccccgccuccaggucccaaaugccagugagcagccaacaggccuccccaugcacaccugagcaggacuggcccugcuggacucccugcucccccaagggcuguccagcagagaccaaagcagaggccaccccgcgguccauccucagguccagccugaacuucuucuugggcaauaaaguaccugcuggugcugaggggcucuccaccuuucccaguuuuucacuagagaagagucug

SEQ ID NO: 47 - RNA, 1431 nt, Homo sapiens
auguacgacgcagagcgcggcuggagcuuguccuucgcgggcugcggcuuccugggcuucuaccacgucggggcgacccgcugccugagcgagcacgccccgcaccuccuccgcgacgcgcgcauguuguucggcgcuucggccggggcguugcacugcgucggcguccucuccgagcagacucugcagguccucucagaucuugugcggaaggccaggagucggaacauuggcaucuuccauccauccuucaacuuaagcaaguuccuccgacagggucucugcaaaugccucccggccaauguccaccagcucaucuccggcaaaauaggcaucucucuuaccagagugucugauggggaaaacguucuggugucugacuuucgguccaaagacgaagucguggaugccuugguauguuccugcuucaugcccuucuacaguggccuuaucccuccuuccuucagaggcgugcgauauguggauggaggagugagugacaacguacccuucauugaugccaaaacaaccaucaccgugucccccuucuauggggaguacgacaucugcccuaaagucaaguccacgaacuuucuucauguggacaucaccaagcucagucuacgccucugcacagggaaccucuaccuucucucgagagcuuuuguccccccggaucucaaggugcugggagagauaugccuucgaggauauuuggaugcauucagguucuuggaagagaagggcaucugcaacaggccccagccaggccugaagucauccucagaagggauggauccugaggucgccaugcccagcugggcaaacaugagucuggauucuuccccggagucggcugccuuggcugugaggcuggagggagaugagcugcuagaccaccugcgucucagcauccugcccugggaugagagcauccuggacacccucucgcccaggcucgcuacagcacugagugaagaaaugaaagacaaagguggauacaugagcaagauuugcaacuugcuacccauuaggauaaugucuuauguaaugcugcccuguacccugccuguggaaucugccauugcgauuguccagagacuggugacauggcuuccagauaugcccgacgauguccugugguugcagugggugaccucacagguguucacucgagugcugaugugucugcuccccgccuccaggucccaaaugccagugagcagccaacaggccuccccaugcacaccugagcaggacuggcccugcuggacucccugcucccccaagggcuguccagcagagaccaaagcagaggccaccccgcgguccauccucagguccagccugaacuucuucuugggcaauaaaguaccugcuggugcugaggggcucuccaccuuucccaguuuuucacuagagaagagucug

SEQ ID NO: 48 - DNA, 1443 bp, Homo sapiens
atgtacgacgcagagcgcggctggagcttgtccttcgcgggctgcggcttcctgggcttctaccacgtcggggcgacccgctgcctgagcgagcacgccccgcacctcctccgcgacgcgcgcatgttgttcggcgcttcggccggggcgttgcactgcgtcggcgtcctctccggtatcccgctggagcagactctgcaggtcctctcagatcttgtgcggaaggccaggagtcggaacattggcatcttccatccatccttcaacttaagcaagttcctccgacagggtctctgcaaatgcctcccggccaatgtccaccagctcatctccggcaaaataggcatctctcttaccagagtgtctgatggggaaaacgttctggtgtctgactttcggtccaaagacgaagtcgtggatgccttggtatgttcctgcttcatccccttctacagtggccttatccctccttccttcagaggcgtgcgatatgtggatggaggagtgagtgacaacgtacccttcattgatgccaaaacaaccatcaccgtgtcccccttctatggggagtacgacatctgccctaaagtcaagtccacgaactttcttcatgtggacatcaccaagctcagtctacgcctctgcacagggaacctctaccttctctcgagagcttttgtccccccggatctcaaggtgctgggagagatatgccttcgaggatatttggatgcattcaggttcttggaagagaagggcatctgcaacaggccccagccaggcctgaagtcatcctcagaagggatggatcctgaggtcgccatgcccagctgggcaaacatgagtctggattcttccccggagtcggctgccttggctgtgaggctggagggagatgagctgctagaccacctgcgtctcagcatcctgccctgggatgagagcatcctggacaccctctcgcccaggctcgctacagcactgagtgaagaaatgaaagacaaaggtggatacatgagcaagatttgcaacttgctacccattaggataatgtcttatgtaatgctgccctgtaccctgcctgtggaatctgccattgcgattgtccagagactggtgacatggcttccagatatgcccgacgatgtcctgtggttgcagtgggtgacctcacaggtgttcactcgagtgctgatgtgtctgctccccgcctccaggtcccaaatgccagtgagcagccaacaggcctccccatgcacacctgagcaggactggccctgctggactccctgctcccccaagggctgtccagcagagaccaaagcagaggccaccccgcggtccatcctcaggtccagcctgaacttcttcttgggcaataaagtacctgctggtgctgaggggctctccacctttcccagtttttcactagagaagagtctg

SEQ ID NO: 49 - DNA, 1431 bp, Homo sapiens
atgtacgacgcagagcgcggctggagcttgtccttcgcgggctgcggcttcctgggcttctaccacgtcggggcgacccgctgcctgagcgagcacgccccgcacctcctccgcgacgcgcgcatgttgttcggcgcttcggccggggcgttgcactgcgtcggcgtcctctccgagcagactctgcaggtcctctcagatcttgtgcggaaggccaggagtcggaacattggcatcttccatccatccttcaacttaagcaagttcctccgacagggtctctgcaaatgcctcccggccaatgtccaccagctcatctccggcaaaataggcatctctcttaccagagtgtctgatggggaaaacgttctggtgtctgactttcggtccaaagacgaagtcgtggatgccttggtatgttcctgcttcatccccttctacagtggccttatccctccttccttcagaggcgtgcgatatgtggatggaggagtgagtgacaacgtacccttcattgatgccaaaacaaccatcaccgtgtcccccttctatggggagtacgacatctgccctaaagtcaagtccacgaactttcttcatgtggacatcaccaagctcagtctacgcctctgcacagggaacctctaccttctctcgagagcttttgtccccccggatctcaaggtgctgggagagatatgccttcgaggatatttggatgcattcaggttcttggaagagaagggcatctgcaacaggccccagccaggcctgaagtcatcctcagaagggatggatcctgaggtcgccatgcccagctgggcaaacatgagtctggattcttccccggagtcggctgccttggctgtgaggctggagggagatgagctgctagaccacctgcgtctcagcatcctgccctgggatgagagcatcctggacaccctctcgcccaggctcgctacagcactgagtgaagaaatgaaagacaaaggtggatacatgagcaagatttgcaacttgctacccattaggataatgtcttatgtaatgctgccctgtaccctgcctgtggaatctgccattgcgattgtccagagactggtgacatggcttccagatatgcccgacgatgtcctgtggttgcagtgggtgacctcacaggtgttcactcgagtgctgatgtgtctgctccccgcctccaggtcccaaatgccagtgagcagccaacaggcctccccatgcacacctgagcaggactggccctgctggactccctgctcccccaagggctgtccagcagagaccaaagcagaggccaccccgcggtccatcctcaggtccagcctgaacttcttcttgggcaataaagtacctgctggtgctgaggggctctccacctttcccagtttttcactagagaagagtctg

SEQ ID NO: 50 - DNA, 1443 bp, Homo sapiens
atgtacgacgcagagcgcggctggagcttgtccttcgcgggctgcggcttcctgggcttctaccacgtcggggcgacccgctgcctgagcgagcacgccccgcacctcctccgcgacgcgcgcatgttgttcggcgcttcggccggggcgttgcactgcgtcggcgtcctctccggtatcccgctggagcagactctgcaggtcctctcagatcttgtgcggaaggccaggagtcggaacattggcatcttccatccatccttcaacttaagcaagttcctccgacagggtctctgcaaatgcctcccggccaatgtccaccagctcatctccggcaaaataggcatctctcttaccagagtgtctgatggggaaaacgttctggtgtctgactttcggtccaaagacgaagtcgtggatgccttggtatgttcctgcttcatgcccttctacagtggccttatccctccttccttcagaggcgtgcgatatgtggatggaggagtgagtgacaacgtacccttcattgatgccaaaacaaccatcaccgtgtcccccttctatggggagtacgacatctgccctaaagtcaagtccacgaactttcttcatgtggacatcaccaagctcagtctacgcctctgcacagggaacctctaccttctctcgagagcttttgtccccccggatctcaaggtgctgggagagatatgccttcgaggatatttggatgcattcaggttcttggaagagaagggcatctgcaacaggccccagccaggcctgaagtcatcctcagaagggatggatcctgaggtcgccatgcccagctgggcaaacatgagtctggattcttccccggagtcggctgccttggctgtgaggctggagggagatgagctgctagaccacctgcgtctcagcatcctgccctgggatgagagcatcctggacaccctctcgcccaggctcgctacagcactgagtgaagaaatgaaagacaaaggtggatacatgagcaagatttgcaacttgctacccattaggataatgtcttatgtaatgctgccctgtaccctgcctgtggaatctgccattgcgattgtccagagactggtgacatggcttccagatatgcccgacgatgtcctgtggttgcagtgggtgacctcacaggtgttcactcgagtgctgatgtgtctgctccccgcctccaggtcccaaatgccagtgagcagccaacaggcctccccatgcacacctgagcaggactggccctgctggactccctgctcccccaagggctgtccagcagagaccaaagcagaggccaccccgcggtccatcctcaggtccagcctgaacttcttcttgggcaataaagtacctgctggtgctgaggggctctccacctttcccagtttttcactagagaagagtctg

SEQ ID NO: 51 - DNA, 1431 bp, Homo sapiens
atgtacgacgcagagcgcggctggagcttgtccttcgcgggctgcggcttcctgggcttctaccacgtcggggcgacccgctgcctgagcgagcacgccccgcacctcctccgcgacgcgcgcatgttgttcggcgcttcggccggggcgttgcactgcgtcggcgtcctctccgagcagactctgcaggtcctctcagatcttgtgcggaaggccaggagtcggaacattggcatcttccatccatccttcaacttaagcaagttcctccgacagggtctctgcaaatgcctcccggccaatgtccaccagctcatctccggcaaaataggcatctctcttaccagagtgtctgatggggaaaacgttctggtgtctgactttcggtccaaagacgaagtcgtggatgccttggtatgttcctgcttcatgcccttctacagtggccttatccctccttccttcagaggcgtgcgatatgtggatggaggagtgagtgacaacgtacccttcattgatgccaaaacaaccatcaccgtgtcccccttctatggggagtacgacatctgccctaaagtcaagtccacgaactttcttcatgtggacatcaccaagctcagtctacgcctctgcacagggaacctctaccttctctcgagagcttttgtccccccggatctcaaggtgctgggagagatatgccttcgaggatatttggatgcattcaggttcttggaagagaagggcatctgcaacaggccccagccaggcctgaagtcatcctcagaagggatggatcctgaggtcgccatgcccagctgggcaaacatgagtctggattcttccccggagtcggctgccttggctgtgaggctggagggagatgagctgctagaccacctgcgtctcagcatcctgccctgggatgagagcatcctggacaccctctcgcccaggctcgctacagcactgagtgaagaaatgaaagacaaaggtggatacatgagcaagatttgcaacttgctacccattaggataatgtcttatgtaatgctgccctgtaccctgcctgtggaatctgccattgcgattgtccagagactggtgacatggcttccagatatgcccgacgatgtcctgtggttgcagtgggtgacctcacaggtgttcactcgagtgctgatgtgtctgctccccgcctccaggtcccaaatgccagtgagcagccaacaggcctccccatgcacacctgagcaggactggccctgctggactccctgctcccccaagggctgtccagcagagaccaaagcagaggccaccccgcggtccatcctcaggtccagcctgaacttcttcttgggcaataaagtacctgctggtgctgaggggctctccacctttcccagtttttcactagagaagagtctg

SEQ ID NO: 52 - DNA, 19118 bp, Homo sapiens
agacagtacctcctccctaggactacacaaggactgaaccagaaggaagaggacagagcaaagccatgaacatcatcctagaaatccttctgcttctgatcaccatcatctactcctacttggagtcgttggtgaagtttttcattcctcagaggagaaaatctgtggctggggagattgttctcattactggagctgggcatggaataggcaggcagactacttatgaatttgcaaaacgacagagcatattggttctgtgggatattaataaggtaatgtatacatcttccaactttttaaagtcacagagtaagatatgtattttaagaattatttgacttaccatctacttatctttgtatttttgtttttcaaagtttgataaattccctggtcccttagtctgtatatgtgtcaggttagttagatgaagggaatgtaattaagaactaagcagcgatttttatgacatggtgtgcaggttgatagaaagactcaggagccagtctccttccaagctgctaaatgaggcaagtcacatattatctctcagcctgttttcttggctctgaagtggggataataacttaggggatgggcaagaacgggatctgaaaattacagctacaaacaaaagtcaaacgaagaacttgcaacagaaacctttagtgcctcccctcatgcacaagcaacacagttctaaaatatttactgtctgaccctttacagaaaatgtttgccagtccgtagtcaaaaggattaaataagtaatattttcagcacttagcatatgataaacgatacgtggcacatgataaacaataactgtgttaaataaaatatgtgcgcagtgagtcaggcttttccttggacattagtatttttcctgtgttcttacttgtaaacactacattaacaaccccaaataaaactgaaggaactgaaatcttgtatcattttctctaaacttgtaaattctggtaaggccatgaaaatatatgcagagaagtgtttacaggattttaggattggaaaaattgtgaagtactccttgagaatcacattttctgcaaattacagtggttttaattaccattatattattactttctcatgttctttgctgtcatgtttagttgaaacctaaaatgtctcttacacttagagaactaattcttttctgttttttttctgaatagtgaagaatactatacaaaaaagctactacatttttatttaacagatatgagcatttatataatagaggagttgatgtatataaaaatgatttgccatctttttggtctttgaagaaattcgaatgaactttctggaagatagcaagaatttacaaatagagaaaattgttgcctgctgttctcaggcatttgtccaaaaatataaataagtataaatctatgaaaagggcttgatgaaatctaaccttcaaatctctttccagatgtgtatttttggggaaagggctatatttattaagttttttttaaattttaaaatttccagagacaagagaaaagtaaattagaaggaagtcgtattaaaaatgacttaagggcgggtgcagtggctcacacctgtaatcccagcactttgggagacggaggtgggcagattgctggagcccaggagttcaagaccagcctgggcagcacagcaaaacccccaactctacaaaaaatacaaaaattagctgggtgcgggggtgcacacccgtagtcccagctactcgggaggctgaggtgggaggatcgtttcagttcaggaagccaaggctgcaatgagctatgatggcatcattgcactccaagctgggcaatagagccaggctctgtctcaaaaaaaataaaaaaagacttaagaaaaataggtaacccaacctcaaaaattctctttgaatcattaaatttcatggttaaacatttaagctactgaatgattcactctaaggctgtaatgtaactcagatctcctttaggcgaggaagatgctggctgagttttcatcataactggctccttttgccctgtgagatgagagacacagtagcagtttggctcttatgcaatctaaactgttgcgttgggaatacggttcaaaaaacacattggagtttaagctaaagcaagtgttttgctaacaaaaagacaaggcatcacattttgcaattgtctagctcagttataaaacagaagaataggccggacgcggtggctcacgcctgtaatcccagcactttgggaggccgagacgggcggatcacgaggtcaggagatcgagaccatcctggataacacagtgaaaccccgtctctactaaaaatacaaaaaaattagccaggcgtagtggcgggcgcctgtagtcccagctactcgggaggctgaggcaggagaatggtgtgaacccgggaggcggagcttgcagtgagccgagatgacgccactgcactccagcctgggcgacagagcgagactccgtctcaaaaaaaaaaaaaaaaaaaaaactgaagaataattaattcttcaatcaaaacatctgatgaatgctctggtaacttatgctctctactgacctagaaacaaatgagagagtatggtgtggtttgtgcaatctggcagtgagcaagctaccaactaaatcagtgaaagactctcctattctttttttactcttctgcaatcccacaaaaggctatttgaggggatactgactttgagactgggtcctaacatccatgtttggggagttcaggctgctgctccagggtttagcctacagtagcgaaatacaaaggacccagagaccactcattcaaggtttgccctaaatagcagcaacaccactgtcatctcaatacacgaagaatagggcttttcaggtatccttgcctctttgtcacagagaagagtttacagattgtgagacggaaaagtataatttttaaaaccttataatattttctataaaagtcacctgaggtgaaaacttgaaaagaattataattttccagaatgtgagtcaagaaacattagagcaattttatcttaggaaagaggtctttgaatttaggctgaaagtaaattgctctgtctccatgtcctatggttatgggcaagtttggtacataaatgagaaatccatccagtggccttgcccatctcactcccaaacacctgaagaatgtaatgttatatctcctagagtagcagcatggtctccctatgaaagtccttcttctttaaggagacttctttcccttccctcctaggaggatgagtcagaatcatcaagaaaaatatgatgggcagaggcatacagtttaccattaccactagtttagaattactacttagcactttactgcctattacatagttggtgctcaacaaatgtatgataaattaatggttgagtttttctttcttctccatattcatcttccatgacaccacgaagagcaatgtttttcaagaatgttcttcaaggtttgaaagtagcctgctttagagaaactgcctactgtacagcctccaaccaagaggaaaagctgaaaaaagcatgaagggattttgttttgttttgtttgttttggttttaatatgagcattccctggcagaaaagccaggggtaatctcattgcaactaggcaatcactctcaagaaattttctaacaaataaggaggccaatttttattttattttgagacgaagtcccactctgtcacccaggttggagtgcaatggaatgatttcagctcactgcaacctccgcctcccgggttcaagtgattctcctgtctaaacttcccgagtagctgggattacaggctcccaccaccacgcccagctaattttttgtatttttagtagagatggggtttcaccattttggccagactggtctcaaactcctgacctcaagtgatccaccctcctcggcctcctaaagtgctgggattacaggcgtgagccaccacacctgacccaggaggccaatttttaaaaggttaactaatcttcatgtccaaaatgaatgttaattgttcattttggacatgaatgttaattttttttttttttttttttgagacagagtctcactctgttgcccaggctggagtccagtggcactatctccactcactgcaacttcctcctcccaggttcaagcaattatcctgcctcagcctcccaagtagctgggattacaggcccacaccatcaggcctggctaatttttgtatttttagtagagacggggtttcaccatgttggccaggctggtcttgaactcctgacctcgtgatccgccctcctcggccaaccaaagtgctgggattacaggcgtgagccaccgcgcctagccgaatgttaattgtctaaaaatttttcttctccaatgtcttctcctccacttttttcggaatttgtttcttcctaattacagcgcggtgtggaggaaactgcagctgagtgccgaaaactaggcgtcactgcgcatgcgtatgtggtagactgcagcaacagagaagagatctatcgctctctaaatcaggtgagactgcaggttcacaaatttcttcagattattttgtttcctaggacgctgacgtggaaaatgagaaaggtctttatgactgcctgatttaaattggattttagctgctaactgaagtagttatgtcaccaaggaaggatatatactttttttcttgtatgtaatccactcagctctgcccattattattgttcatattattaatcaatttcattctgatcagaagtgtgagcagtggcacagagtgactgacaaaagatttatcatcagggaatatggatcacttcctagttttgttttagtcctattaactttgcagtaattccagcttctctttaattatttcccttgtgagattttattttggtgttaatgtagtcttctgtagaaaatgtaatattaataattattatcacaattattttaaaagagtaaataccaaataatcacaatgaactaagcactctaacaaactttacattttttaattcaatccctacaataactctgtaaacttcattttacagataagcaaattatgactcagagaggttaagccagacccaggtcatgtagttattaggttatgaaaccaggatttctcaaccagcactttagaccaggtgcggtggttcacacatgtaatcccagcactttgtgaggccaaggtggaaggatcacatgagaccaagagttcaagaccagcccaggcaacatagtgagaccctatctctaaaaaaaaaaaaaaaaaaaaaaaaaaaagtttaaagaaaaacacatttttaaaaaatgaacactttaaaaatatttggtcagaatttatataggaatttatcaacataaatgttaatttcactttactgataaacttgcaaaacatgatgtgctgggtactgaaatttagatgttaaaagaacagtttatcccacctttatgacagtgttcccttggcctccacgatttgagctcaacagtctgtcttgcctgaactctgagagacctcatacaatagaagaaagactctcatctttggattatattggtcccaaaactttgagtttgaataatacacccagtgaaagtgttctttcaatttcaaaaggtgaagaaagaagtgggtgatgtaacaatcgtggtgaataatgctgggacagtatatccagccgatcttctcagcaccaaggatgaagagattaccaagacatttgaggtcaacatcctaggacatttttgggtgagtgtgagtcagaaacatttctgatttgtgcaccttctcttaagatacatgaaacttataacggagttcacatacttctggacaggaaactggccagatctttgccttaatcaagaatcattaaatttgtttgagtagaagagccacagagtctctgacacaaggacacagaattcaagtggacacaacacaccagaatgtaagctacttggtctgtcttgtccaccagtatctgacacaaagcttggcatgtaccaggagctcaacaaatgtttgtggaggtttgttaagggttgtcagtgtacatcttttcaatgctgtcacttgtgacttcatttttttccctccacaccatgattttgtaatgtgtcctcattttgtggaattttagaatggaaaggacatcagaagtaattacttggatgtatataggatcgaggacacttttggacgagactctgaggcaagtgttctagatccatggggtgctggaactgagaaatgcagctatacagacctcatataattggttagttttgtgggagatggaaatatcaacttcaactgcctttgtatagaaatttttatgattaatcttccagtgcctcaatattagtgtagaatctagggcagatctggattctagaagaaagaagaaaaaaaagagatgtgtcccccttacctttaccagctcttcacatatgtgaattggctcccatgcccaccaaactacacggagacctcatacattagctacctatagctgcataacaaattatacaaaacttagtggtttaaagcaacaatgtatgttcactatcctctcacagtttctatgggttgggaatttggaggtagcttgggttgggagttctagttctatgaatttgcataggatttattaaattcttataaaattttattgatgtttctcacaaaagaggtttttggaaaaaaagaaagacttgttttctgtaacatcaacatataatatacaatattacaaatagggagatagtgaattcaatcatgattcattagtgtggtgtagaactctcagcttacactactcaactgtcttaatacagttacacaagatttcactcttttaattagaatgataaagccccaaaccaaaaaattatatgacaccaaattatcataaggaataattttagttctgaaaactctgaatttttcccttaatattgtttagatgacatatccaaaaaaggatctatttgattccttctgaagggaaggagggggagtactgagattagtgttggcatggggcttaccataccaataaatttgtatctttatttctatcatttgtaaagaattaatcatggaatgcttggaagtattttatttcattgtataagttctctcaaatgcctttctgtcttaacaaaaataaaactacctgatttggaaacctaacgtctatgtcattgtctttcttctttctgcaatgatccttaagatcacaaaagcacttcttccatcgatgatggagagaaatcatggccacatcgtcacagtggcttcagtgtgcggccacgaagggattccttacctcatcccatattggtaagtatcacatgccagccatgttatatatttttatactttgaagggagcattacacttcaaattgttaccactggagagtcctggttcttggcatcttgaacaaagaattggacaaaactcaccaacaaagccaggaaagaatgaagcaacaaaagcagagatttattgaaaatgaaagtacgctttacagggtgggagtgggcccaagcacaggggctcaagagccaattacagaattttctggggtttaaataccccctagaggtttccactggttacttggtgtacgccctatgtaaatgaagaggatgaattaaagttacagagtcgtttactcagtgtacaccatatgtaaatggagaggatatttcctgtcatagctggagtgtttccatttgatttagttctaggaagtcagcatgaatcggccttatgttccctgcctccagaccctgttctcctgcctcaagattacaatgctgagagcagagtgatttggatttacagaatttaaatttatagtagtttagaatgattttttaaatgactttttctaaaacaatgaaaccaggttgtaattatatttaagatatttttagatttctgcaaactcctctgtagaacaatgagagaaaacagtaatgccaagcatgtttccattgtttcctggaataagaaacagaaaccccacagactgagaagcaaaacctacagaagctaaaatgaacacatgtctatgtcatggccttggtgcccaagataagacaatcagagtggtccctggatcaaaacattttacagtgtgcttgtgccatgaaagtgtgtgtgtgtgtgtgtgtgtgtgtgtgagagagagagagagagagaaaacgactctacctgactaaaagttgcagataccacactccatgcaccaccaaagacataaagggaaggaggtgagaggcgttaaggatgtactgctgtatttgccaaatatcctttcctgtaaactcttctccagatcctcataataaaattaagaggccaaagtggcaaccattgtcaagagaaaaactatcaaccattgtcaagagaataactcagttattgagagagagaggagaaatgagcagagtcctacagaagtctgtcaacacagataccagttttgtagaatttctaaatgtatttttcctgattcatatttttcaaaataaaagcagcaataaaaactgattagaaaacagtttgaagattcaatggaaaaaccttacatgtaggatggaaaactgaacattaagccaatcaatagagttatttttgttcttttgttatcattgttgtttaagaaatgagatacgttcacaattctgcttaatcatgtaagaaaatgaaaatgaattgccatttatactctcagaaaaatcacaagtggctgatttttggcttccacttgttcttaagccaaatgataccgccttctcacagaaagctgaggattggtttcactctcccttagctaacaatgcttaataattctcttacagttccagcaaatttgccgctgttggctttcacagaggtctgacatcagaacttcaggccttgggaaaaactggtatcaaaacctcatgtctctgcccagtttttgtgaatactgggttcaccaaaaatccaagcacaaggtaaggtcaaaatcaagttagaatgggtatgtggtatgataaattgatatgaaaactaatgagaaatgtttaggcaggccaactaatagaagaaaatgaagaaggaaaaataatttttcttattattattattatcttgaaattaaaggaataaagggggaaaacacattagggactagcaggaatgatcagccaccgatgaactgggatatttatttgtgtccgggagaaagcacatacatttgatcaccgttaccaccctgtctttaaaatgcaaatgttccaaggaccagcaaataaattgagtatctagctccttagtcaaggtgaatttctgcaagaactcttgtctctggtgagacaggatttgagaccacaagagaagaaaaattagtcctgaaaggagaagaaaaaagcaggaaggtgtggataagaacccgaaaattaagccatctgcttaacaaatttttctaatcctagtatatattctgctgcaggttaacaaaatatactaagcttaatgattcgaaaccaattttttactggaagggaattaatcctaaatatattcattcaaaagaactaaacaattctctgttgagtgccgcctcatttgaggatactgactcttacagcctgagttagctatgtggtctctgcagctggaatcactccctgccactggagtccttcatggtgttagaccataggtactgttgactaaagaaaaaaaaaagtttttgtttttatttttgttttttttgagacagagtctcactctgtcacccaggctggagtacagtggcgcgatctcagctcaccgcaacctccgcctttctgggttcaagcaattctccttcctcagcctcctgagtatttggattacaggcgcccaccaccacgcctggctaatttttgtatttttagtagagacggggtttcaccatgttggccaggctggtctcaaactcctgacctcaggtgtcctacctgccttggcctcctaaaatgctgggattacaggagtgagccaccatgcccggccaaaaaaataagtttttaaagaattaaaggtcatcctggctaacacagtgaaaccccgtctctactaaaaaacacaaaaaaattagccgggcgtggtggcgggcgcctgtagtcccagctgcgcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaaaaaaaagaattaaaggtgttaattttatttagaagccttactgaagactacagtcggaggcctatagcctgagagcagccctttagagaggttcagttgaactgttctgatagtgggggccatgtgctctatcctgtattgtcttcaaagcatctttccagagagctgcacattgtcacagagtcagggactttgtgaaattatgctgacaaccagaagtgagtaaacgtggcttcttacatttgctacgttgtctcacagtacttaataagtatgcaatatgtaagtaaatactatagtactattgcaactcctgattgttttcttagacaaggaattgggcccaataaaaaccctcttggtaggcattcaggcttcgtgtaccatgagctttcctaagggtatcctgccactcttggggaaggcatgatagatgaggggagtaaggataatggaactctgggtacagggttcctgggggctaacttagaggtagacacaggcaatgctaaatatttgggattgattttatagaggttgctagattgtgaatttccttagtaagggctaaggcattgatatgtaatgtcacacttggctccgaggctgggttgttggatccatgtagatgaaatcagggagagaaagggcagaacggagtaatttagaaatgtattgatttgtattactctctgttggcttgctattcaaggcagtggagaactcaatcacataataatctgcagcaaaccacagatcatcccagggaatgaagttttaacattcgctggctccctaactcctcacccagcctttacattcactggctgttcagtccatgcctggacatcttaatttgaatacaacattttaaatccatttttctgtcatcatcttgcactaacagacaattctacactaagcctatgtttatgaatatttctcaagagtacatgtacacagccttcagtataaggaaaactggaagtatgacatacctccagttgtcatactccttgggcccctcttaaattctcattaaactgcaggataggcaagtcagaggtgaatctcaaatacgaaattcttaccggaaaggggttccaatccagaccccaagagagggttcttagatttctcgcaagaaataattcggggcaaggccacagtgcaaagcaaaagcaagtttattaggaaagtaaaggagtagagaacagctactccatggagaagaatggcttgagctgctccaccaagggtatttagagttacttcttgattatatgctaaacaaggggtggattattcatgagttttccgggaaaagggtgagcaattcccagaactgagatttcctcccctttttaggccatatagggtaacttcctgccattgccatggtatttgtaaactgtcatagtgctggtggaagtgtctcttagcttgctaatgtattatagttagcttataatgagcagtgaggacaaccagaggtcactttcatcaccatcttggttttggtgggttttggccggcttctttactgcaccctattttatcaacaaggtctttatgacctgaatcttgtgccaacctcctatctcatcctgtgacaaagaatgccttaacttcctgggaatgcagcccagtaggtgtcagccttattttacccagaccctattcaagatggagttgctctgatttaaacgcctctgacaaaatgacgacctcaaaacaatccagctttatggaatacctccacaagaaagaaagtatacttagctatagaattttctccttgcatccaacaggctttgagatgtcagatgtttccttcctgtcccatgattaatcctagccattcctctttcttgtctggctccactactccttaccatctaatgcctcgccaccattttgatattttgactaagtgagctatgaaacacacctactggatatgaaagtataagtttctgataacaaaacatcaacatgggatgtggaggaagtgggtagggtggcattaatgcagcaaatcctggaatattttaaatcttcattctaaatttagtaaaaatataggataattttcctgccatcatttacttataaaattaaaattttagaaaataaaaataatattttcctctttttaatcacagattatggcctgtattggagacagatgaagtcgtaagaagtctgatagatggaatacttaccaataagaaaatgatttttgttccatcgtatatcaatatctttctgagactacagaagtaagtacagcacagaacacccaaatactaaaacaccaatagagcttttttttttgctttttttttttttagacagagtctcactctgtcaccctggctggattgcggtggttgcagtggcatgatcttggctcactgcaacctccgcctcctgggttcaagcaattctcatgcctcagacccccaagtaactgggattataggtgtgtgctgccacactacacccagctaatttttgtattttttgatagagacaggtttccccatgttggccaggctggactcgaactcctgacctcaagttatcctcctgtctcggcctcccaaagtgctgggattacagtcatgagccaccatgcctggcccaatagagctattattatggagcatctttcagttgtgaaaattggcatggaaactctccatccctggggagaacagttatttcctctgttattttcctacccagtctataaaaagagagtgattcattttctctaccaaatctactgtctctgcccaaactttgctgaagactattctaactaaaggaaacacagtttaaaaagaatgcaatatagtgaagtagttaataataaagactccatttttaaaagtctgctggaagtttggttgggattgcactgaatctatagagcaattggggagtattgacatatcaacaatattgagttttctaatccaagaacataatatctatttttaaaatcttcttcaaaatctttaaatctttaaattgtattttgtagtttttggtgtttaagtcttgcacatattttgtcagatttattccaaagtatttcacgggttcttttttttttttttttttttttttttgagacagagtttcacccttgttgcccaggctggagtgcagtggcgtgatcttggctcactgcagcttctgcctcctggcttcaagtgattctcctgcctcagcctcccaagtagctgggattacaggcacctgccccctcgcccaactaactttttgtgtttgtagtagagacagggtttcaccatgttggccaggctggtctcgaactcctgacctcatgtgatccacctgcctcagcctcccaaagtgctgggattacaggcatgagccatcatgcccagccctatttgacggtttttgacgctaatgcaagtggcattttaaaaaattttatatttcccattgtttgttgtcagtatatattggatttttgtaatttgatctcatattttgcagtcttgctaaattgctaaacctctttttgctaaactcgataagcttttttttttttggtagattcctgggcctctaattttctttatgggaaagtttttaattacaaatttaatttctttaatagctacatggctattcaatttacttattaattcttggtaatgtgtgtctttcaaggaatttgtccatttcatctaagttgtagaatttctttggcataaatttgtacataacattcccttattatccttttaatgtctttagaatgtcttatttatttatttatttatttttattatatttttttgagacagagtctcgctctgttgcccaggctggagtgcagtggcacaatcttggctcactgcaagctccgccttctgggttcatgccattctcctgcctcagcctccctagttgctgggactacaggcgcctgcaaccatgcccagcttattttttttttttttttttttttttttttttttttttttttttttttagtagagacggggtttcaccctgttagccaggatggtctcgatctcctgacctggtgatccgcccgcctcagcctcccaaagtgctgggattacaggcgtgagccaccaagcccagcctatttatttatttagtagagacagtctcactttgctgcccaggcaacaaaggttttgaatgcctggcctcaagcagtcctcctgccttggcctcccaaagtgctgggattacaggcatgagccactgcacctggccaaatgaatatgctgataatatcttctttataaggatgacataagaataaaataatgtaatacaaacaaagcccctgtcactgaaaatgtatagacttcaaatgttaaagtcttagagaacagaatttatatgaaatagcaacagcaacaatttcccagaggaaatactctctcagctttcttctgaggagcagtttctaaattgaaattgtatcagtgagaagataactatactaacttcataagccttgggcctttttgaaacaaatccatataaactatgaacaaacttgaaatagaacaatttgagaacagggtacaaactgcattggtgtatcaatttcagtatttggttttagcttaaatagactgacttgagataacataaggagaaccttgacccccaagcaacatcatctcgcgagttgactaggccgggtgtggtgtctcacgcctgtaattccagcactttgggaggccacagcaggcagatcacttgaggtcaggcattcgagaccagcctggccaacatggtgaaacctcagctctactaaagatacgaaaattagcaggcatagtggcctgcacctgtaataccaggcactcgcaggagaatcccttgaacccggaaggcggagattgcagtaaaccatgattgtgccactgcactccagcctgggcaacaggagactctgtctcggaaaaataaattttttaaaaaaatgaaaaaaaataaaagttgactaaattagtgtcttggtactaagcactgtaggaagtgagtttcatggaaccccaactctcttggggcccaaagcaagtcatattaatattgaaaattacatgcatatacatgcatatgaccaaggtgataaaaacaattattctgcctgagttggagaatagtatcccagtaaaataaacaagagtctcaaagtcttttgtatcctttgaagctgtcatggtggtttgtaactaggcaacaggtatatattgttaatcttctttgcatttaattccttttatagagagacacaattttacgagcagatgcaattactagcatgaaggtttctttgtgagggtagttaaaaggcccacatgagctctcttcttatccttgtccttctttcagccagatcttccctgcccctttgctcattccatctttcacccacctacccccaaaacaaggaagtaaatcttgcattagtcaacaataccaaagtgattttcaatatgactttctctgcagaatgttattatttctgcctctttacattcacatactgtcttcctttttttttttttttttttttttttttttagattgggtctcactctgttgcccaggctggagtgcagtggcttgatctcagctcactgtaacctccacctcctgagttcaagcaattctcctgcctcagcctcctgagtagctgggattacaggcatgtgccaccacacctggctagtttttttgtatttttagtagagacagggtttcaccatgttggtcaagctggtctcgaactcctgacctcatgatctgaccacctgtgcctctcaaagtgctgggattacaggcgtgagccaccgggccagccactctcttcctttcagttgcctactcatctcttatgcattcctggacatcagttgtccttttgaagctttcctccactatcccagcccatgtgaatcctccttccagttatagcccttaattctagatggctgatatttttcaataattgttttaagatgaccattttagcctatcagctaaacaatatcaaagacaatagctatttttcaagtactttagtttaccttattatagagtgcataatagatattcagtaaatagtaaaggagaggtgaaggcttgcatagaatggattctggtggtgtctcttggtgagcttttagcatcaagattaatcagcagtttcagcaatgagctcagaccttcagttttagatctttactcatatcagataagagagtgagaagagtggtatgtatcagtgctttatttatatttgcatccaatttgaactatgaatattacaaaggtgcacacataggttcagacagattgatttaaaatgaccaaagatgacctgtcgtaagcaacctgggtatcttaagatgcactccttggagagggaatgttcctaaaaacattttcagagggacgaactgtatgaaattcagtaaaacataaatcatgaggaaaactgattactctctttttgacatgaaatgagagttttaatgcatggttacgattattaacgtactccgctgcaagacgttaataaagttactgttttgcaggctagaatgtcttgatgctgtaatcagaacacactttttcccctttcttccagcttcaaatgcagattcataattgggctgacttctaataactgcaatgttttctgccttgggcttgcagcagaagcctgacaaaatagtgtttgtttaggcaataatttatttatttatttattgagatggagtttcattcttgtcgcccaggctggagtgcaatggcgtgatctcggctcactgcaacctctgtgttcaggcaataatttagactttaccttacttgtgattactatagcaattactatagccacaaggcataattttactgtctcatttcaattttatgaatttgaatgtttttacacttttcctaatgaagtccactatgaagttatgtcaaaaaaaaaaaagaaaaagaaagatgcacacgtaaaagagaggtggttgcaagagaagaaaagaacggaggaaagttaaacgcaaaccagataactctcagcgtattctaaatgaccaaaaacagaactctgttgtcaaagattttaaatggaaaatttttcaatttttttttcttttttgtacaggtttcttcctgaacgcgcctcagcgattttaaatcgtatgcagaatattcaatttgaagcagtggttggccacaaaatcaaaatgaaatgaataaataagctccagccagagatgtatgcatgataatgatatgaatagtttcgaatcaatgctgcaaagctttatttcacattttttcagtcctgataatattaaaaacattggtttggcactagcagcagtcaaacgaacaagattaattacctgtcttcctgtttctcaagaatatttacgtagtttttcataggtctgtttttcctttcatgcctcttaaaaacttctgtgcttacataaacatacttaaaaggttttctttaagatattttatttttccatttaaaggtggacaaaagctacctccctaaaagtaaatacaaagagaacttatttacacagggaaggtttaagactgttcaagtagcattccaatctgtagccatgccacagaatatcaacaagaacacagaatgagtgcacagctaagagatcaagtttcagcaggcagctttatctcaacctggacatattttaagattcagcatttgaaagatttccctagcctcttcctttttcattagcccaaaacggtgcaactctattctggactttattacttgattctgtcttctgtataactctgaagtccaccaaaagtggaccctctatatttcctccctttttatagtcttataagatacattatgaaaggtgaccgactctattttaaatctcagaattttaagttctagccccatgataacctttttctttgtaatttatgctttcatatatccttggtcccagagatgtttagacaattttaggctcaaaaattaaagctaacacaggaaaaggaactgtactggctattacataagaaacaatggacccaagagaagaaaaggaagaaagaaaggttttttggtttttgttttgttttgttttgttttttgtttttttgagatggagtctcactctttcgcccaggctggagtgcagtggtatgatctcagctcactgcaagctccacctcccgggttcacgccattctcctgcctcagcctcctgagtagctgggactacaggcgcccgccaccacacccggctaattttttgtattttttgtagagacggggtttcaccatgttagccaagatggtctcgatctcctgacctcgtgatccacctgcctcggcctcccaaagtgctgggattacgggtgtgagccaccgtgcccagcctttttttttttaatagaaaaaataatccgactcccactacatcaagactaatcttgttttgtgtgtttttcacatgtattatagaatgcttttgcatggactatcctcttgtttttattaaaaacaaatgatttttttaaaagtcacaaaaacaattcactaaaaataaatatgtcattgtgctttaaaaaaataacctcttgtagttataaaataaaacgtttgacttctaaactctg

SEQ ID NO: 53 - RNA, 2269 nt, Homo sapiens
gacuacacaaggacugaaccagaaggaagaggacagagcaaagccaugaacaucauccuagaaauccuucugcuucugaucaccaucaucuacuccuacuuggagucguuggugaaguuuuucauuccucagaggagaaaaucuguggcuggggagauuguucucauuacuggagcugggcauggaauaggcaggcagacuacuuaugaauuugcaaaacgacagagcauauugguucugugggauauuaauaaggugaagaaagaagugggugauguaacaaucguggugaauaaugcugggacaguauauccagccgaucuucucagcaccaaggaugaagagauuaccaagacauuugaggucaacauccuaggacauuuuuggaucacaaaagcacuucuuccaucgaugauggagagaaaucauggccacaucgucacaguggcuucagugugcggccacgaagggauuccuuaccucaucccauauuguuccagcaaauuugccgcuguuggcuuucacagaggucugacaucagaacuucaggccuugggaaaaacugguaucaaaaccucaugucucugcccaguuuuugugaauacuggguucaccaaaaauccaagcacaagauuauggccuguauuggagacagaugaagucguaagaagucugauagauggaauacuuaccaauaagaaaaugauuuuuguuccaucguauaucaauaucuuucugagacuacagaaguuucuuccugaacgcgccucagcgauuuuaaaucguaugcagaauauucaauuugaagcagugguuggccacaaaaucaaaaugaaaugaauaaauaagcuccagccagagauguaugcaugauaaugauaugaauaguuucgaaucaaugcugcaaagcuuuauuucacauuuuuucaguccugauaauauuaaaaacauugguuuggcacuagcagcagucaaacgaacaagauuaauuaccugucuuccuguuucucaagaauauuuacguaguuuuucauaggucuguuuuuccuuucaugccucuuaaaaacuucugugcuuacauaaacauacuuaaaagguuuucuuuaagauauuuuauuuuuccauuuaaagguggacaaaagcuaccucccuaaaaguaaauacaaagagaacuuauuuacacagggaagguuuaagacuguucaaguagcauuccaaucuguagccaugccacagaauaucaacaagaacacagaaugagugcacagcuaagagaucaaguuucagcaggcagcuuuaucucaaccuggacauauuuuaagauucagcauuugaaagauuucccuagccucuuccuuuuucauuagcccaaaacggugcaacucuauucuggacuuuauuacuugauucugucuucuguauaacucugaaguccaccaaaaguggacccucuauauuuccucccuuuuuauagucuuauaagauacauuaugaaaggugaccgacucuauuuuaaaucucagaauuuuaaguucuagccccaugauaaccuuuuucuuuguaauuuaugcuuucauauauccuuggucccagagauguuuagacaauuuuaggcucaaaaauuaaagcuaacacaggaaaaggaacuguacuggcuauuacauaagaaacaauggacccaagagaagaaaaggaagaaagaaagguuuuuugguuuuuguuuuguuuuguuuuguuuuuuguuuuuuugagauggagucucacucuuucgcccaggcuggagugcagugguaugaucucagcucacugcaagcuccaccucccggguucacgccauucuccugccucagccuccugaguagcugggacuacaggcgcccgccaccacacccggcuaauuuuuuguauuuuuuguagagacgggguuucaccauguuagccaagauggucucgaucuccugaccucgugauccaccugccucggccucccaaagugcugggauuacgggugugagccaccgugcccagccuuuuuuuuuuuaauagaaaaaauaauccgacucccacuacaucaagacuaaucuuguuuuguguguuuuucacauguauuauagaaugcuuuugcauggacuauccucuuguuuuuauuaaaaacaaaugauuuuuuuaaaagucacaaaaacaauucacuaaaaauaaauaugucauugugcuuuaaaaaaauaaccucuuguaguuauaaaauaaaacguuugacuucuaaacucug

SEQ ID NO: 54 - RNA, 2368 nt, Homo sapiens
acacaaggacugaaccagaaggaagaggacagagcaaagccaugaacaucauccuagaaauccuucugcuucugaucaccaucaucuacuccuacuuggagucguuggugaaguuuuucauuccucagaggagaaaaucuguggcuggggagauuguucucauuacuggagcugggcauggaauaggcaggcagacuacuuaugaauuugcaaaacgacagagcauauugguucugugggauauuaauaagcgcgguguggaggaaacugcagcugagugccgaaaacuaggcgucacugcgcaugcguaugugguagacugcagcaacagagaagagaucuaucgcucucuaaaucaggugaagaaagaagugggugauguaacaaucguggugaauaaugcugggacaguauauccagccgaucuucucagcaccaaggaugaagagauuaccaagacauuugaggucaacauccuaggacauuuuuggaucacaaaagcacuucuuccaucgaugauggagagaaaucauggccacaucgucacaguggcuucagugugcggccacgaagggauuccuuaccucaucccauauuguuccagcaaauuugccgcuguuggcuuucacagaggucugacaucagaacuucaggccuugggaaaaacugguaucaaaaccucaugucucugcccaguuuuugugaauacuggguucaccaaaaauccaagcacaagauuauggccuguauuggagacagaugaagucguaagaagucugauagauggaauacuuaccaauaagaaaaugauuuuuguuccaucguauaucaauaucuuucugagacuacagaaguuucuuccugaacgcgccucagcgauuuuaaaucguaugcagaauauucaauuugaagcagugguuggccacaaaaucaaaaugaaaugaauaaauaagcuccagccagagauguaugcaugauaaugauaugaauaguuucgaaucaaugcugcaaagcuuuauuucacauuuuuucaguccugauaauauuaaaaacauugguuuggcacuagcagcagucaaacgaacaagauuaauuaccugucuuccuguuucucaagaauauuuacguaguuuuucauaggucuguuuuuccuuucaugccucuuaaaaacuucugugcuuacauaaacauacuuaaaagguuuucuuuaagauauuuuauuuuuccauuuaaagguggacaaaagcuaccucccuaaaaguaaauacaaagagaacuuauuuacacagggaagguuuaagacuguucaaguagcauuccaaucuguagccaugccacagaauaucaacaagaacacagaaugagugcacagcuaagagaucaaguuucagcaggcagcuuuaucucaaccuggacauauuuuaagauucagcauuugaaagauuucccuagccucuuccuuuuucauuagcccaaaacggugcaacucuauucuggacuuuauuacuugauucugucuucuguauaacucugaaguccaccaaaaguggacccucuauauuuccucccuuuuuauagucuuauaagauacauuaugaaaggugaccgacucuauuuuaaaucucagaauuuuaaguucuagccccaugauaaccuuuuucuuuguaauuuaugcuuucauauauccuuggucccagagauguuuagacaauuuuaggcucaaaaauuaaagcuaacacaggaaaaggaacuguacuggcuauuacauaagaaacaauggacccaagagaagaaaaggaagaaagaaagguuuuuugguuuuuguuuuguuuuguuuuguuuuuuguuuuuuugagauggagucucacucuuucgcccaggcuggagugcagugguaugaucucagcucacugcaagcuccaccucccggguucacgccauucuccugccucagccuccugaguagcugggacuacaggcgcccgccaccacacccggcuaauuuuuuguauuuuuuguagagacgggguuucaccauguuagccaagauggucucgaucuccugaccucgugauccaccugccucggccucccaaagugcugggauuacgggugugagccaccgugcccagccuuuuuuuuuuuaauagaaaaaauaauccgacucccacuacaucaagacuaaucuuguuuuguguguuuuucacauguauuauagaaugcuuuugcauggacuauccucuuguuuuuauuaaaaacaaaugauuuuuuuaaaagucacaaaaacaauucacuaaaaauaaauaugucauugugcuuuaaaaaaauaaccucuuguaguuauaaaauaaaacguuugacuucuaaa

SEQ ID NO: 55 - RNA, 2260 nt, Homo sapiens
acacaaggacugaaccagaaggaagaggacagagcaaagccaugaacaucauccuagaaauccuucugcuucugaucaccaucaucuacuccuacuuggagucguuggugaaguuuuucauuccucagaggagaaaaucuguggcuggggagauuguucucauuacuggagcugggcauggaauaggcaggcagacuacuuaugaauuugcaaaacgacagagcauauugguucugugggauauuaauaaggugaagaaagaagugggugauguaacaaucguggugaauaaugcugggacaguauauccagccgaucuucucagcaccaaggaugaagagauuaccaagacauuugaggucaacauccuaggacauuuuuggaucacaaaagcacuucuuccaucgaugauggagagaaaucauggccacaucgucacaguggcuucagugugcggccacgaagggauuccuuaccucaucccauauuguuccagcaaauuugccgcuguuggcuuucacagaggucugacaucagaacuucaggccuugggaaaaacugguaucaaaaccucaugucucugcccaguuuuugugaauacuggguucaccaaaaauccaagcacaagauuauggccuguauuggagacagaugaagucguaagaagucugauagauggaauacuuaccaauaagaaaaugauuuuuguuccaucguauaucaauaucuuucugagacuacagaaguuucuuccugaacgcgccucagcgauuuuaaaucguaugcagaauauucaauuugaagcagugguuggccacaaaaucaaaaugaaaugaauaaauaagcuccagccagagauguaugcaugauaaugauaugaauaguuucgaaucaaugcugcaaagcuuuauuucacauuuuuucaguccugauaauauuaaaaacauugguuuggcacuagcagcagucaaacgaacaagauuaauuaccugucuuccuguuucucaagaauauuuacguaguuuuucauaggucuguuuuuccuuucaugccucuuaaaaacuucugugcuuacauaaacauacuuaaaagguuuucuuuaagauauuuuauuuuuccauuuaaagguggacaaaagcuaccucccuaaaaguaaauacaaagagaacuuauuuacacagggaagguuuaagacuguucaaguagcauuccaaucuguagccaugccacagaauaucaacaagaacacagaaugagugcacagcuaagagaucaaguuucagcaggcagcuuuaucucaaccuggacauauuuuaagauucagcauuugaaagauuucccuagccucuuccuuuuucauuagcccaaaacggugcaacucuauucuggacuuuauuacuugauucugucuucuguauaacucugaaguccaccaaaaguggacccucuauauuuccucccuuuuuauagucuuauaagauacauuaugaaaggugaccgacucuauuuuaaaucucagaauuuuaaguucuagccccaugauaaccuuuuucuuuguaauuuaugcuuucauauauccuuggucccagagauguuuagacaauuuuaggcucaaaaauuaaagcuaacacaggaaaaggaacuguacuggcuauuacauaagaaacaauggacccaagagaagaaaaggaagaaagaaagguuuuuugguuuuuguuuuguuuuguuuuguuuuuuguuuuuuugagauggagucucacucuuucgcccaggcuggagugcagugguaugaucucagcucacugcaagcuccaccucccggguucacgccauucuccugccucagccuccugaguagcugggacuacaggcgcccgccaccacacccggcuaauuuuuuguauuuuuuguagagacgggguuucaccauguuagccaagauggucucgaucuccugaccucgugauccaccugccucggccucccaaagugcugggauuacgggugugagccaccgugcccagccuuuuuuuuuuuaauagaaaaaauaauccgacucccacuacaucaagacuaaucuuguuuuguguguuuuucacauguauuauagaaugcuuuugcauggacuauccucuuguuuuuauuaaaaacaaaugauuuuuuuaaaagucacaaaaacaauucacuaaaaauaaauaugucauugugcuuuaaaaaaauaaccucuuguaguuauaaaauaaaacguuugacuucuaaa

SEQ ID NO: 56 - RNA, 2377 nt, Homo sapiens
gacuacacaaggacugaaccagaaggaagaggacagagcaaagccaugaacaucauccuagaaauccuucugcuucugaucaccaucaucuacuccuacuuggagucguuggugaaguuuuucauuccucagaggagaaaaucuguggcuggggagauuguucucauuacuggagcugggcauggaauaggcaggcagacuacuuaugaauuugcaaaacgacagagcauauugguucugugggauauuaauaagcgcgguguggaggaaacugcagcugagugccgaaaacuaggcgucacugcgcaugcguaugugguagacugcagcaacagagaagagaucuaucgcucucuaaaucaggugaagaaagaagugggugauguaacaaucguggugaauaaugcugggacaguauauccagccgaucuucucagcaccaaggaugaagagauuaccaagacauuugaggucaacauccuaggacauuuuuggaucacaaaagcacuucuuccaucgaugauggagagaaaucauggccacaucgucacaguggcuucagugugcggccacgaagggauuccuuaccucaucccauauuguuccagcaaauuugccgcuguuggcuuucacagaggucugacaucagaacuucaggccuugggaaaaacugguaucaaaaccucaugucucugcccaguuuuugugaauacuggguucaccaaaaauccaagcacaagauuauggccuguauuggagacagaugaagucguaagaagucugauagauggaauacuuaccaauaagaaaaugauuuuuguuucaucguauaucaauaucuuucugagacuacagaaguuucuuccugaacgcgccucagcgauuuuaaaucguaugcaaaauauucaauuugaagcagugguuggccacaaaaucaaaaugaaaugaauaaauaagcuccagccagagauguaugcaugauaaugauaugaauaguuucgaaucaaugcugcaaagcuuuauuucacauuuuuucaguccugauaauauuaaaaacauugguuuggcacuagcagcagucaaacgaacaagauuaauuaccugucuuccuguuucucaagaauauuuacguaguuuuucauaggucuguuuuuccuuucaugccucuuaaaaacuucugugcuuacauaaacauacuuaaaagguuuucuuuaagauauuuuauuuuuccauuuaaagguggacaaaagcuaccucccuaaaaguaaauacaaagagaacuuauuuacacagggaagguuuaagacuguucaaguagcauuccaaucuguagccaugccacagaauaucaacaagaacacagaaugagugcacagcuaagagaucaaguuucagcaggcagcuuuaucucaaccuggacauauuuuaagauucagcauuugaaagauuucccuagccucuuccuuuuucauuagcccaaaacggugcaacucuauucuggacuuuauuacuugauucugucuucuguauaacucugaaguccaccaaaaguggacccucuauauuuccucccuuuuuauagucuuauaagauacauuaugaaaggugaccgacucuauuuuaaaucucagaauuuuaaguucuagccccaugauaaccuuuuucuuuguaauuuaugcuuucauauauccuuggucccagagauguuuagacaauuuuaggcucaaaaauuaaagcuaacacaggaaaaggaacuguacuggcuauuacauaagaaacaauggacccaagagaagaaaaggaagaaagaaagguuuuuugguuuuuguuuuguuuuguuuuguuuuuuguuuuuuugagauggagucucacucuuucgcccaggcuggagugcagugguaugaucucagcucacugcaagcuccaccucccggguucacgccauucuccugccucagccuccugaguagcugggacuacaggcgcccgccaccacacccggcuaauuuuuuguauuuuuuguagagacgggguuucaccauguuagccaagauggucucgaucuccugaccucgugauccaccugccucggccucccaaagugcugggauuacgggugugagccaccgugcccagccuuuuuuuuuuuaauagaaaaaauaauccgacucccacuacaucaagacuaaucuuguuuuguguguuuuucacauguauuauagaaugcuuuugcauggacuauccucuuguuuuuauuaaaaacaaaugauuuuuuuaaaagucacaaaaacaauucacuaaaaauaaauaugucauugugcuuuaaaaaaauaaccucuuguaguuauaaaauaaaacguuugacuucuaaacucug

SEQ ID NO: 57 - RNA, 2367 nt, Homo sapiens
gacugaaccagaaggaagaggacagagcaaagccaugaacaucauccuagaaauccuucugcuucugaucaccaucaucuacuccuacuuggagucguuggugaaguuuuucauuccucagaggagaaaaucuguggcuggggagauuguucucauuacuggagcugggcauggaauaggcaggcagacuacuuaugaauuugcaaaacgacagagcauauugguucugugggauauuaauaagcgcgguguggaggaaacugcagcugagugccgaaaacuaggcgucacugcgcaugcguaugugguagacugcagcaacagagaagagaucuaucgcucucuaaaucaggugaagaaagaagugggugauguaacaaucguggugaauaaugcugggacaguauauccagccgaucuucucagcaccaaggaugaagagauuaccaagacauuugaggucaacauccuaggacauuuuuggaucacaaaagcacuucuuccaucgaugauggagagaaaucauggccacaucgucacaguggcuucagugugcggccacgaagggauuccuuaccucaucccauauuguuccagcaaauuugccgcuguuggcuuucacagaggucugacaucagaacuucaggccuugggaaaaacugguaucaaaaccucaugucucugcccaguuuuugugaauacuggguucaccaaaaauccaagcacaagauuauggccuguauuggagacagaugaagucguaagaagucugauagauggaauacuuaccaauaagaaaaugauuuuuguuccaucguauaucaauaucuuucugagacuacagaaguuucuuccugaacgcgccucagcgauuuuaaaucguaugcagaauauucaauuugaagcagugguuggccacaaaaucaaaaugaaaugaauaaauaagcuccagccagagauguaugcaugauaaugauaugaauaguuucgaaucaaugcugcaaagcuuuauuucacauuuuuucaguccugauaauauuaaaaacauugguuuggcacuagcagcagucaaacgaacaagauuaauuaccugucuuccuguuucucaagaauauuuacguaguuuuucauaggucuguuuuuccuuucaugccucuuaaaaacuucugugcuuacauaaacauacuuaaaagguuuucuuuaagauauuuuauuuuuccauuuaaagguggacaaaagcuaccucccuaaaaguaaauacaaagagaacuuauuuacacagggaagguuuaagacuguucaaguagcauuccaaucuguagccaugccacagaauaucaacaagaacacagaaugagugcacagcuaagagaucaaguuucagcaggcagcuuuaucucaaccuggacauauuuuaagauucagcauuugaaagauuucccuagccucuuccuuuuucauuagcccaaaacggugcaacucuauucuggacuuuauuacuugauucugucuucuguauaacucugaaguccaccaaaaguggacccucuauauuuccucccuuuuuauagucuuauaagauacauuaugaaaggugaccgacucuauuuuaaaucucagaauuuuaaguucuagccccaugauaaccuuuuucuuuguaauuuaugcuuucauauauccuuggucccagagauguuuagacaauuuuaggcucaaaaauuaaagcuaacacaggaaaaggaacuguacuggcuauuacauaagaaacaauggacccaagagaagaaaaggaagaaagaaagguuuuuugguuuuuguuuuguuuuguuuuguuuuuuguuuuuuugagauggagucucacucuuucgcccaggcuggagugcagucguaugaucucagcucacugcaagcuccaccucccggguucacgccauucuccugccucagccuccugaguagcugggacuacaggcgcccgccaccacacccggcuaauuuuuuguauuuuuuguagagacgggguuucaccauguuagccaagauggucucgaucuccugaccucgugauccaccugccucggccucccaaagugcugggauuacgggugugagccaccgugcccagccuuuuuuuuuuuuaauagaaaaaauaauccgacucccacuacaucaagacuaaucuuguuuuguguguuuuucacauguauuauagaaugcuuuugcauggacuauccucuuguuuuuauuaaaaacaaaugauuuuuuuaaaagucacaaaaacaauucacuaaaaauaaauaugucauugugcuuuaaaaaaauaaccucuuguaguuauaaaauaaaacguuugacuucuaaaaaaaa

SEQ ID NO: 58 - RNA, 1818 nt, Homo sapiens
agacaguaccuccucccuaggacuacacaaggacugaaccagaaggaagaggacagagcaaagccaugaacaucauccuagaaauccuucugcuucugaucaccaucaucuacuccuacuuggagucguuggugaaguuuuucauuccucagaggagaaaaucuguggcuggggagauuguucucauuacuggagcugggcauggaauaggcaggcagacuacuuaugaauuugcaaaacgacagagcauauugguucugugggauauuaauaagcgcgguguggaggaaacugcagcugagugccgaaaacuaggcgucacugcgcaugcguaugugguagacugcagcaacagagaagagaucuaucgcucucuaaaucaggugaagaaagaagugggugauguaacaaucguggugaauaaugcugggacaguauauccagccgaucuucucagcaccaaggaugaagagauuaccaagacauuugaggucaacauccuaggacauuuuuggaucacaaaagcacuucuuccaucgaugauggagagaaaucauggccacaucgucacaguggcuucagugugcggccacgaagggauuccuuaccucaucccauauuguuccagcaaauuugccgcuguuggcuuucacagaggucugacaucagaacuucaggccuugggaaaaacugguaucaaaaccucaugucucugcccaguuuuugugaauacuggguucaccaaaaauccaagcacaagauuauggccuguauuggagacagaugaagucguaagaagucugauagauggaauacuuaccaauaagaaaaugauuuuuguuccaucguauaucaauaucuuucugagacuacagaaguuucuuccugaacgcgccucagcgauuuuaaaucguaugcagaauauucaauuugaagcagugguuggccacaaaaucaaaaugaaaugaauaaauaagcuccagccagagauguaugcaugauaaugauaugaauaguuucgaaucaaugcugcaaagcuuuauuucacauuuuuucaguccugauaauauuaaaaacauugguuuggcacuagcagcagucaaacgaacaagauuaauuaccugucuuccuguuucucaagaauauuuacguaguuuuucauaggucuguuuuuccuuucaugccucuuaaaaacuucugugcuuacauaaacauacuuaaaagguuuucuuuaagauauuuuauuuuuccauuuaaagguggacaaaagcuaccucccuaaaaguaaauacaaagagaacuuauuuacacagggaagguuuaagacuguucaaguagcauuccaaucuguagccaugccacagaauaucaacaagaacacagaaugagugcacagcuaagagaucaaguuucagcaggcagcuuuaucucaaccuggacauauuuuaagauucagcauuugaaagauuucccuagccucuuccuuuuucauuagcccaaaacggugcaacucuauucuggacuuuauuacuugauucugucuucuguauaacucugaaguccaccaaaaguggacccucuauauuuccucccuuuuuauagucuuauaagauacauuaugaaaggugaccgacucuauuuuaaaucucagaauuuuaaguucuagccccaugauaaccuuuuucuuuguaauuuaugcuuucauauauccuuggucccagagauguuuagacaauuuuaggcucaaaaauuaaagcuaacacaggaaaaggaacuguacuggcuauuacauaagaaacaauggacccaagagaagaa

SEQ ID NO: 59 - RNA, 1531 nt, Homo sapiens
acaaggacugaaccagaaggaagaggacagagcaaagccaugaacaucauccuagaaauccuucugcuucugaucaccaucaucuacuccuacuuggagucguuggugaaguuuuucauuccucagaggagaaaaucuguggcuggggagauuguucucauuacuggagcugggcauggaauaggcaggcagacuacuuaugaauuugcaaaacgacagagcauauugguucugugggauauuaauaagcgcgguguggaggaaacugcagcugagugccgaaaacuaggcgucacugcgcaugcguaugugguagacugcagcaacagagaagagaucuaucgcucucuaaaucaggugaagaaagaagugggugauguaacaaucguggugaauaaugcugggacaguauauccagccgaucuucucagcaccaaggaugaagagauuaccaagacauuugaggucaacauccuaggacauuuuuggaucacaaaagcacuucuuccaucgaugauggagagaaaucauggccacaucgucacaguggcuucagugugcggccacgaagggauuccuuaccucaucccauauuguuccagcaaauuugccgcuguuggcuuucacagaggucugacaucagaacuucaggccuugggaaaaacugguaucaaaaccucaugucucugcccaguuuuugugaauacuggguucaccaaaaauccaagcacaagauuauggccuguauuggagacagaugaagucguaagaagucugauagauggaauacuuaccaauaagaaaaugauuuuuguuccaucguauaucaauaucuuucugagacuacagaaguuucuuccugaacgcgccucagcgauuuuaaaucguaugcagaauauucaauuugaagcagugguuggccacaaaaucaaaaugaaaugaauaaauaagcuccagccagagauguaugcaugauaaugauaugaauaguuucgaaucaaugcugcaaagcuuuauuucacauuuuuucaguccugauaauauuaaaaacauugguuuggcacuagcagcagucaaacgaacaagauuaauuaccugucuuccuguuucucaagaauauuuacguaguuuuucauaggucuguuuuuccuuucaugccucuuaaaaacuucugugcuuacauaaacauacuuaaaagguuuucuuuaagauauuuuauuuuuccauuuaaagguggacaaaagcuaccucccuaaaaguaaauacaaagagaacuuauuuacacagggaagguuuaagacuguucaaguagcauuccaaucuguagccaugccacagaauaucaacaagaacacagaaugagugcacagcuaagagaucaagcuucagcaggcagcuuuaucucaaccuggacauauuuuaagauucagcauuugaaagauuucccuagccucuuccuuuuucauuagcccaaaacggugcaacucuauucuggacuuuauuacuugauucugucuucuguauaacucug

SEQ ID NO: 60 - RNA, 1040 nt, Homo sapiens
ggacagagcaaagccaugaacaucauccuagaaauccuucugcuucugaucaccaucaucuacuccuacuuggagucguuggugaaguuuuucauuccucagaggagaaaaucuguggcuggggagauuguucucauuacuggagcugggcauggaauaggcaggcagacuacuuaugaauuugcaaaacgacagagcauauugguucugugggauauuaauaagcgcgguguggaggaaacugcagcugagugccgaaaacuaggcgucacugcgcaugcguaugugguagacugcagcaacagagaagagaucuaucgcucucuaaaucaggugaagaaagaagugggugauguaacaaucguggugaauaaugcugggacaguauauccagccgaucuucucagcaccaaggaugaagagauuaccaagacauuugaggucaacauccuaggacauuuuuggaucacaaaagcacuucuuccaucgaugauggagagaaaucauggccacaucgucacaguggcuucagugugcggccacgaagggauuccuuaccucaucccauauuguuccagcaaauuugccgcuguuggcuuucacagaggucugacaucagaacuucaggccuugggaaaaacugguaucaaaaccucaugucucugcccaguuuuugugaauacuggguucaccaaaaauccaagcacaagauuauggccuguauuggagacagaugaagucguaagaagucugauagauggaauacuuaccaauaagaaaaugauuuuuguuccaucguauaucaauaucuuucugagacuacagaaguuucuuccugaacgcgccucagcgauuuuaaaucguaugcagaauauucaauuugaagcagugguuggccacaaaaucaaaaugaaaugaauaaauaagcuccagccagagauguaugcaugauaaugauaugaauaguuucgaaucaaugcugcaaagcuuuauuucacauuuuuucaguccugauaauauuaaaaacauugguuuggcac

SEQ ID NO: 61 - RNA, 955 nt, Homo sapiens
gaaggaagaggacagagcaaagccaugaacaucauccuagaaauccuucugcuucugaucaccaucaucuacuccuacuuggagucguuggugaaguuuuucauuccucagaggagaaaaucuguggcuggggagauuguucucauuacuggagcugggcauggaauaggcaggcagacuacuuaugaauuugcaaaacgacagagcauauugguucugugggauauuaauaagcgcgguguggaggaaacugcagcugagugccgaaaacuaggcgucacugcgcaugcguaugugguagacugcagcaacagagaagagaucuaucgcucucuaaaucaggugaagaaagaagugggugauguaacaaucguggugaauaaugcugggacaguauauccagccgaucuucucagcaccaaggaugaagagauuaccaagacauuugaggucaacauccuaggacauuuuuggaucacaaaagcacuucuuccaucgaugauggagagaaaucauggccacaucgucacaguggcuucagugugcggccacgaagggauuccuuaccucaucccauauuguuccagcaaauuugccgcuguuggcuuucacagaggucugacaucagaacuucaggccuugggaaaaacugguaucaaaaccucaugucucugcccaguuuuugugaauacuggguucaccaaaaauccaagcacaagauuauggccuguauuggagacagaugaagucguaagaagucugauagauggaauacuuaccaauaagaaaaugauuuuuguuccaucguauaucaauaucuuucugagacuacagaaguuucuuccugaacgcgccucagcgauuuuaaaucguaugcagaauauucaauuugaagcagugguuggccacaaaaucaaaaugaaaugaauaaauaagcuccagccagagauguaug

SEQ ID NO: 62 - RNA, 2397 nt, Homo sapiens
agacaguaccuccucccuaggacuacacaaggacugaaccagaaggaagaggacagagcaaagccaugaacaucauccuagaaauccuucugcuucugaucaccaucaucuacuccuacuuggagucguuggugaaguuuuucauuccucagaggagaaaaucuguggcuggggagauuguucucauuacuggagcugggcauggaauaggcaggcagacuacuuaugaauuugcaaaacgacagagcauauugguucugugggauauuaauaagcgcgguguggaggaaacugcagcugagugccgaaaacuaggcgucacugcgcaugcguaugugguagacugcagcaacagagaagagaucuaucgcucucuaaaucaggugaagaaagaagugggugauguaacaaucguggugaauaaugcugggacaguauauccagccgaucuucucagcaccaaggaugaagagauuaccaagacauuugaggucaacauccuaggacauuuuuggaucacaaaagcacuucuuccaucgaugauggagagaaaucauggccacaucgucacaguggcuucagugugcggccacgaagggauuccuuaccucaucccauauuguuccagcaaauuugccgcuguuggcuuucacagaggucugacaucagaacuucaggccuugggaaaaacugguaucaaaaccucaugucucugcccaguuuuugugaauacuggguucaccaaaaauccaagcacaagauuauggccuguauuggagacagaugaagucguaagaagucugauagauggaauacuuaccaauaagaaaaugauuuuuguuccaucguauaucaauaucuuucugagacuacagaaguuucuuccugaacgcgccucagcgauuuuaaaucguaugcagaauauucaauuugaagcagugguuggccacaaaaucaaaaugaaaugaauaaauaagcuccagccagagauguaugcaugauaaugauaugaauaguuucgaaucaaugcugcaaagcuuuauuucacauuuuuucaguccugauaauauuaaaaacauugguuuggcacuagcagcagucaaacgaacaagauuaauuaccugucuuccuguuucucaagaauauuuacguaguuuuucauaggucuguuuuuccuuucaugccucuuaaaaacuucugugcuuacauaaacauacuuaaaagguuuucuuuaagauauuuuauuuuuccauuuaaagguggacaaaagcuaccucccuaaaaguaaauacaaagagaacuuauuuacacagggaagguuuaagacuguucaaguagcauuccaaucuguagccaugccacagaauaucaacaagaacacagaaugagugcacagcuaagagaucaaguuucagcaggcagcuuuaucucaaccuggacauauuuuaagauucagcauuugaaagauuucccuagccucuuccuuuuucauuagcccaaaacggugcaacucuauucuggacuuuauuacuugauucugucuucuguauaacucugaaguccaccaaaaguggacccucuauauuuccucccuuuuuauagucuuauaagauacauuaugaaaggugaccgacucuauuuuaaaucucagaauuuuaaguucuagccccaugauaaccuuuuucuuuguaauuuaugcuuucauauauccuuggucccagagauguuuagacaauuuuaggcucaaaaauuaaagcuaacacaggaaaaggaacuguacuggcuauuacauaagaaacaauggacccaagagaagaaaaggaagaaagaaagguuuuuugguuuuuguuuuguuuuguuuuguuuuuuguuuuuuugagauggagucucacucuuucgcccaggcuggagugcagugguaugaucucagcucacugcaagcuccaccucccggguucacgccauucuccugccucagccuccugaguagcugggacuacaggcgcccgccaccacacccggcuaauuuuuuguauuuuuuguagagacgggguuucaccauguuagccaagauggucucgaucuccugaccucgugauccaccugccucggccucccaaagugcugggauuacgggugugagccaccgugcccagccuuuuuuuuuuuaauagaaaaaauaauccgacucccacuacaucaagacuaaucuuguuuuguguguuuuucacauguauuauagaaugcuuuugcauggacuauccucuuguuuuuauuaaaaacaaaugauuuuuuuaaaagucacaaaaacaauucacuaaaaauaaauaugucauugugcuuuaaaaaaauaaccucuuguaguuauaaaauaaaacguuugacuucuaaacucug

SEQ ID NO: 63 - DNA, 2269 bp, Homo sapiens
gactacacaaggactgaaccagaaggaagaggacagagcaaagccatgaacatcatcctagaaatccttctgcttctgatcaccatcatctactcctacttggagtcgttggtgaagtttttcattcctcagaggagaaaatctgtggctggggagattgttctcattactggagctgggcatggaataggcaggcagactacttatgaatttgcaaaacgacagagcatattggttctgtgggatattaataaggtgaagaaagaagtgggtgatgtaacaatcgtggtgaataatgctgggacagtatatccagccgatcttctcagcaccaaggatgaagagattaccaagacatttgaggtcaacatcctaggacatttttggatcacaaaagcacttcttccatcgatgatggagagaaatcatggccacatcgtcacagtggcttcagtgtgcggccacgaagggattccttacctcatcccatattgttccagcaaatttgccgctgttggctttcacagaggtctgacatcagaacttcaggccttgggaaaaactggtatcaaaacctcatgtctctgcccagtttttgtgaatactgggttcaccaaaaatccaagcacaagattatggcctgtattggagacagatgaagtcgtaagaagtctgatagatggaatacttaccaataagaaaatgatttttgttccatcgtatatcaatatctttctgagactacagaagtttcttcctgaacgcgcctcagcgattttaaatcgtatgcagaatattcaatttgaagcagtggttggccacaaaatcaaaatgaaatgaataaataagctccagccagagatgtatgcatgataatgatatgaatagtttcgaatcaatgctgcaaagctttatttcacattttttcagtcctgataatattaaaaacattggtttggcactagcagcagtcaaacgaacaagattaattacctgtcttcctgtttctcaagaatatttacgtagtttttcataggtctgtttttcctttcatgcctcttaaaaacttctgtgcttacataaacatacttaaaaggttttctttaagatattttatttttccatttaaaggtggacaaaagctacctccctaaaagtaaatacaaagagaacttatttacacagggaaggtttaagactgttcaagtagcattccaatctgtagccatgccacagaatatcaacaagaacacagaatgagtgcacagctaagagatcaagtttcagcaggcagctttatctcaacctggacatattttaagattcagcatttgaaagatttccctagcctcttcctttttcattagcccaaaacggtgcaactctattctggactttattacttgattctgtcttctgtataactctgaagtccaccaaaagtggaccctctatatttcctccctttttatagtcttataagatacattatgaaaggtgaccgactctattttaaatctcagaattttaagttctagccccatgataacctttttctttgtaatttatgctttcatatatccttggtcccagagatgtttagacaattttaggctcaaaaattaaagctaacacaggaaaaggaactgtactggctattacataagaaacaatggacccaagagaagaaaaggaagaaagaaaggttttttggtttttgttttgttttgttttgttttttgtttttttgagatggagtctcactctttcgcccaggctggagtgcagtggtatgatctcagctcactgcaagctccacctcccgggttcacgccattctcctgcctcagcctcctgagtagctgggactacaggcgcccgccaccacacccggctaattttttgtattttttgtagagacggggtttcaccatgttagccaagatggtctcgatctcctgacctcgtgatccacctgcctcggcctcccaaagtgctgggattacgggtgtgagccaccgtgcccagcctttttttttttaatagaaaaaataatccgactcccactacatcaagactaatcttgttttgtgtgtttttcacatgtattatagaatgcttttgcatggactatcctcttgtttttattaaaaacaaatgatttttttaaaagtcacaaaaacaattcactaaaaataaatatgtcattgtgctttaaaaaaataacctcttgtagttataaaataaaacgtttgacttctaaactctg

SEQ ID NO: 64 - DNA, 2368 bp, Homo sapiens
acacaaggactgaaccagaaggaagaggacagagcaaagccatgaacatcatcctagaaatccttctgcttctgatcaccatcatctactcctacttggagtcgttggtgaagtttttcattcctcagaggagaaaatctgtggctggggagattgttctcattactggagctgggcatggaataggcaggcagactacttatgaatttgcaaaacgacagagcatattggttctgtgggatattaataagcgcggtgtggaggaaactgcagctgagtgccgaaaactaggcgtcactgcgcatgcgtatgtggtagactgcagcaacagagaagagatctatcgctctctaaatcaggtgaagaaagaagtgggtgatgtaacaatcgtggtgaataatgctgggacagtatatccagccgatcttctcagcaccaaggatgaagagattaccaagacatttgaggtcaacatcctaggacatttttggatcacaaaagcacttcttccatcgatgatggagagaaatcatggccacatcgtcacagtggcttcagtgtgcggccacgaagggattccttacctcatcccatattgttccagcaaatttgccgctgttggctttcacagaggtctgacatcagaacttcaggccttgggaaaaactggtatcaaaacctcatgtctctgcccagtttttgtgaatactgggttcaccaaaaatccaagcacaagattatggcctgtattggagacagatgaagtcgtaagaagtctgatagatggaatacttaccaataagaaaatgatttttgttccatcgtatatcaatatctttctgagactacagaagtttcttcctgaacgcgcctcagcgattttaaatcgtatgcagaatattcaatttgaagcagtggttggccacaaaatcaaaatgaaatgaataaataagctccagccagagatgtatgcatgataatgatatgaatagtttcgaatcaatgctgcaaagctttatttcacattttttcagtcctgataatattaaaaacattggtttggcactagcagcagtcaaacgaacaagattaattacctgtcttcctgtttctcaagaatatttacgtagtttttcataggtctgtttttcctttcatgcctcttaaaaacttctgtgcttacataaacatacttaaaaggttttctttaagatattttatttttccatttaaaggtggacaaaagctacctccctaaaagtaaatacaaagagaacttatttacacagggaaggtttaagactgttcaagtagcattccaatctgtagccatgccacagaatatcaacaagaacacagaatgagtgcacagctaagagatcaagtttcagcaggcagctttatctcaacctggacatattttaagattcagcatttgaaagatttccctagcctcttcctttttcattagcccaaaacggtgcaactctattctggactttattacttgattctgtcttctgtataactctgaagtccaccaaaagtggaccctctatatttcctccctttttatagtcttataagatacattatgaaaggtgaccgactctattttaaatctcagaattttaagttctagccccatgataacctttttctttgtaatttatgctttcatatatccttggtcccagagatgtttagacaattttaggctcaaaaattaaagctaacacaggaaaaggaactgtactggctattacataagaaacaatggacccaagagaagaaaaggaagaaagaaaggttttttggtttttgttttgttttgttttgttttttgtttttttgagatggagtctcactctttcgcccaggctggagtgcagtggtatgatctcagctcactgcaagctccacctcccgggttcacgccattctcctgcctcagcctcctgagtagctgggactacaggcgcccgccaccacacccggctaattttttgtattttttgtagagacggggtttcaccatgttagccaagatggtctcgatctcctgacctcgtgatccacctgcctcggcctcccaaagtgctgggattacgggtgtgagccaccgtgcccagcctttttttttttaatagaaaaaataatccgactcccactacatcaagactaatcttgttttgtgtgtttttcacatgtattatagaatgcttttgcatggactatcctcttgtttttattaaaaacaaatgatttttttaaaagtcacaaaaacaattcactaaaaataaatatgtcattgtgctttaaaaaaataacctcttgtagttataaaataaaacgtttgacttctaaa

SEQ ID NO: 65 - DNA, 2260 bp, Homo sapiens
acacaaggactgaaccagaaggaagaggacagagcaaagccatgaacatcatcctagaaatccttctgcttctgatcaccatcatctactcctacttggagtcgttggtgaagtttttcattcctcagaggagaaaatctgtggctggggagattgttctcattactggagctgggcatggaataggcaggcagactacttatgaatttgcaaaacgacagagcatattggttctgtgggatattaataaggtgaagaaagaagtgggtgatgtaacaatcgtggtgaataatgctgggacagtatatccagccgatcttctcagcaccaaggatgaagagattaccaagacatttgaggtcaacatcctaggacatttttggatcacaaaagcacttcttccatcgatgatggagagaaatcatggccacatcgtcacagtggcttcagtgtgcggccacgaagggattccttacctcatcccatattgttccagcaaatttgccgctgttggctttcacagaggtctgacatcagaacttcaggccttgggaaaaactggtatcaaaacctcatgtctctgcccagtttttgtgaatactgggttcaccaaaaatccaagcacaagattatggcctgtattggagacagatgaagtcgtaagaagtctgatagatggaatacttaccaataagaaaatgatttttgttccatcgtatatcaatatctttctgagactacagaagtttcttcctgaacgcgcctcagcgattttaaatcgtatgcagaatattcaatttgaagcagtggttggccacaaaatcaaaatgaaatgaataaataagctccagccagagatgtatgcatgataatgatatgaatagtttcgaatcaatgctgcaaagctttatttcacattttttcagtcctgataatattaaaaacattggtttggcactagcagcagtcaaacgaacaagattaattacctgtcttcctgtttctcaagaatatttacgtagtttttcataggtctgtttttcctttcatgcctcttaaaaacttctgtgcttacataaacatacttaaaaggttttctttaagatattttatttttccatttaaaggtggacaaaagctacctccctaaaagtaaatacaaagagaacttatttacacagggaaggtttaagactgttcaagtagcattccaatctgtagccatgccacagaatatcaacaagaacacagaatgagtgcacagctaagagatcaagtttcagcaggcagctttatctcaacctggacatattttaagattcagcatttgaaagatttccctagcctcttcctttttcattagcccaaaacggtgcaactctattctggactttattacttgattctgtcttctgtataactctgaagtccaccaaaagtggaccctctatatttcctccctttttatagtcttataagatacattatgaaaggtgaccgactctattttaaatctcagaattttaagttctagccccatgataacctttttctttgtaatttatgctttcatatatccttggtcccagagatgtttagacaattttaggctcaaaaattaaagctaacacaggaaaaggaactgtactggctattacataagaaacaatggacccaagagaagaaaaggaagaaagaaaggttttttggtttttgttttgttttgttttgttttttgtttttttgagatggagtctcactctttcgcccaggctggagtgcagtggtatgatctcagctcactgcaagctccacctcccgggttcacgccattctcctgcctcagcctcctgagtagctgggactacaggcgcccgccaccacacccggctaattttttgtattttttgtagagacggggtttcaccatgttagccaagatggtctcgatctcctgacctcgtgatccacctgcctcggcctcccaaagtgctgggattacgggtgtgagccaccgtgcccagcctttttttttttaatagaaaaaataatccgactcccactacatcaagactaatcttgttttgtgtgtttttcacatgtattatagaatgcttttgcatggactatcctcttgtttttattaaaaacaaatgatttttttaaaagtcacaaaaacaattcactaaaaataaatatgtcattgtgctttaaaaaaataacctcttgtagttataaaataaaacgtttgacttctaaa

SEQ ID NO: 66 - DNA, 2377 bp, Homo sapiens
gactacacaaggactgaaccagaaggaagaggacagagcaaagccatgaacatcatcctagaaatccttctgcttctgatcaccatcatctactcctacttggagtcgttggtgaagtttttcattcctcagaggagaaaatctgtggctggggagattgttctcattactggagctgggcatggaataggcaggcagactacttatgaatttgcaaaacgacagagcatattggttctgtgggatattaataagcgcggtgtggaggaaactgcagctgagtgccgaaaactaggcgtcactgcgcatgcgtatgtggtagactgcagcaacagagaagagatctatcgctctctaaatcaggtgaagaaagaagtgggtgatgtaacaatcgtggtgaataatgctgggacagtatatccagccgatcttctcagcaccaaggatgaagagattaccaagacatttgaggtcaacatcctaggacatttttggatcacaaaagcacttcttccatcgatgatggagagaaatcatggccacatcgtcacagtggcttcagtgtgcggccacgaagggattccttacctcatcccatattgttccagcaaatttgccgctgttggctttcacagaggtctgacatcagaacttcaggccttgggaaaaactggtatcaaaacctcatgtctctgcccagtttttgtgaatactgggttcaccaaaaatccaagcacaagattatggcctgtattggagacagatgaagtcgtaagaagtctgatagatggaatacttaccaataagaaaatgatttttgtttcatcgtatatcaatatctttctgagactacagaagtttcttcctgaacgcgcctcagcgattttaaatcgtatgcaaaatattcaatttgaagcagtggttggccacaaaatcaaaatgaaatgaataaataagctccagccagagatgtatgcatgataatgatatgaatagtttcgaatcaatgctgcaaagctttatttcacattttttcagtcctgataatattaaaaacattggtttggcactagcagcagtcaaacgaacaagattaattacctgtcttcctgtttctcaagaatatttacgtagtttttcataggtctgtttttcctttcatgcctcttaaaaacttctgtgcttacataaacatacttaaaaggttttctttaagatattttatttttccatttaaaggtggacaaaagctacctccctaaaagtaaatacaaagagaacttatttacacagggaaggtttaagactgttcaagtagcattccaatctgtagccatgccacagaatatcaacaagaacacagaatgagtgcacagctaagagatcaagtttcagcaggcagctttatctcaacctggacatattttaagattcagcatttgaaagatttccctagcctcttcctttttcattagcccaaaacggtgcaactctattctggactttattacttgattctgtcttctgtataactctgaagtccaccaaaagtggaccctctatatttcctccctttttatagtcttataagatacattatgaaaggtgaccgactctattttaaatctcagaattttaagttctagccccatgataacctttttctttgtaatttatgctttcatatatccttggtcccagagatgtttagacaattttaggctcaaaaattaaagctaacacaggaaaaggaactgtactggctattacataagaaacaatggacccaagagaagaaaaggaagaaagaaaggttttttggtttttgttttgttttgttttgttttttgtttttttgagatggagtctcactctttcgcccaggctggagtgcagtggtatgatctcagctcactgcaagctccacctcccgggttcacgccattctcctgcctcagcctcctgagtagctgggactacaggcgcccgccaccacacccggctaattttttgtattttttgtagagacggggtttcaccatgttagccaagatggtctcgatctcctgacctcgtgatccacctgcctcggcctcccaaagtgctgggattacgggtgtgagccaccgtgcccagcctttttttttttaatagaaaaaataatccgactcccactacatcaagactaatcttgttttgtgtgtttttcacatgtattatagaatgcttttgcatggactatcctcttgtttttattaaaaacaaatgatttttttaaaagtcacaaaaacaattcactaaaaataaatatgtcattgtgctttaaaaaaataacctcttgtagttataaaataaaacgtttgacttctaaactctg

SEQ ID NO: 67 - DNA, 2367 bp, Homo sapiens
gactgaaccagaaggaagaggacagagcaaagccatgaacatcatcctagaaatccttctgcttctgatcaccatcatctactcctacttggagtcgttggtgaagtttttcattcctcagaggagaaaatctgtggctggggagattgttctcattactggagctgggcatggaataggcaggcagactacttatgaatttgcaaaacgacagagcatattggttctgtgggatattaataagcgcggtgtggaggaaactgcagctgagtgccgaaaactaggcgtcactgcgcatgcgtatgtggtagactgcagcaacagagaagagatctatcgctctctaaatcaggtgaagaaagaagtgggtgatgtaacaatcgtggtgaataatgctgggacagtatatccagccgatcttctcagcaccaaggatgaagagattaccaagacatttgaggtcaacatcctaggacatttttggatcacaaaagcacttcttccatcgatgatggagagaaatcatggccacatcgtcacagtggcttcagtgtgcggccacgaagggattccttacctcatcccatattgttccagcaaatttgccgctgttggctttcacagaggtctgacatcagaacttcaggccttgggaaaaactggtatcaaaacctcatgtctctgcccagtttttgtgaatactgggttcaccaaaaatccaagcacaagattatggcctgtattggagacagatgaagtcgtaagaagtctgatagatggaatacttaccaataagaaaatgatttttgttccatcgtatatcaatatctttctgagactacagaagtttcttcctgaacgcgcctcagcgattttaaatcgtatgcagaatattcaatttgaagcagtggttggccacaaaatcaaaatgaaatgaataaataagctccagccagagatgtatgcatgataatgatatgaatagtttcgaatcaatgctgcaaagctttatttcacattttttcagtcctgataatattaaaaacattggtttggcactagcagcagtcaaacgaacaagattaattacctgtcttcctgtttctcaagaatatttacgtagtttttcataggtctgtttttcctttcatgcctcttaaaaacttctgtgcttacataaacatacttaaaaggttttctttaagatattttatttttccatttaaaggtggacaaaagctacctccctaaaagtaaatacaaagagaacttatttacacagggaaggtttaagactgttcaagtagcattccaatctgtagccatgccacagaatatcaacaagaacacagaatgagtgcacagctaagagatcaagtttcagcaggcagctttatctcaacctggacatattttaagattcagcatttgaaagatttccctagcctcttcctttttcattagcccaaaacggtgcaactctattctggactttattacttgattctgtcttctgtataactctgaagtccaccaaaagtggaccctctatatttcctccctttttatagtcttataagatacattatgaaaggtgaccgactctattttaaatctcagaattttaagttctagccccatgataacctttttctttgtaatttatgctttcatatatccttggtcccagagatgtttagacaattttaggctcaaaaattaaagctaacacaggaaaaggaactgtactggctattacataagaaacaatggacccaagagaagaaaaggaagaaagaaaggttttttggtttttgttttgttttgttttgttttttgtttttttgagatggagtctcactctttcgcccaggctggagtgcagtcgtatgatctcagctcactgcaagctccacctcccgggttcacgccattctcctgcctcagcctcctgagtagctgggactacaggcgcccgccaccacacccggctaattttttgtattttttgtagagacggggtttcaccatgttagccaagatggtctcgatctcctgacctcgtgatccacctgcctcggcctcccaaagtgctgggattacgggtgtgagccaccgtgcccagccttttttttttttaatagaaaaaataatccgactcccactacatcaagactaatcttgttttgtgtgtttttcacatgtattatagaatgcttttgcatggactatcctcttgtttttattaaaaacaaatgatttttttaaaagtcacaaaaacaattcactaaaaataaatatgtcattgtgctttaaaaaaataacctcttgtagttataaaataaaacgtttgacttctaaaaaaaa

SEQ ID NO: 68 - DNA, 1818 bp, Homo sapiens
agacagtacctcctccctaggactacacaaggactgaaccagaaggaagaggacagagcaaagccatgaacatcatcctagaaatccttctgcttctgatcaccatcatctactcctacttggagtcgttggtgaagtttttcattcctcagaggagaaaatctgtggctggggagattgttctcattactggagctgggcatggaataggcaggcagactacttatgaatttgcaaaacgacagagcatattggttctgtgggatattaataagcgcggtgtggaggaaactgcagctgagtgccgaaaactaggcgtcactgcgcatgcgtatgtggtagactgcagcaacagagaagagatctatcgctctctaaatcaggtgaagaaagaagtgggtgatgtaacaatcgtggtgaataatgctgggacagtatatccagccgatcttctcagcaccaaggatgaagagattaccaagacatttgaggtcaacatcctaggacatttttggatcacaaaagcacttcttccatcgatgatggagagaaatcatggccacatcgtcacagtggcttcagtgtgcggccacgaagggattccttacctcatcccatattgttccagcaaatttgccgctgttggctttcacagaggtctgacatcagaacttcaggccttgggaaaaactggtatcaaaacctcatgtctctgcccagtttttgtgaatactgggttcaccaaaaatccaagcacaagattatggcctgtattggagacagatgaagtcgtaagaagtctgatagatggaatacttaccaataagaaaatgatttttgttccatcgtatatcaatatctttctgagactacagaagtttcttcctgaacgcgcctcagcgattttaaatcgtatgcagaatattcaatttgaagcagtggttggccacaaaatcaaaatgaaatgaataaataagctccagccagagatgtatgcatgataatgatatgaatagtttcgaatcaatgctgcaaagctttatttcacattttttcagtcctgataatattaaaaacattggtttggcactagcagcagtcaaacgaacaagattaattacctgtcttcctgtttctcaagaatatttacgtagtttttcataggtctgtttttcctttcatgcctcttaaaaacttctgtgcttacataaacatacttaaaaggttttctttaagatattttatttttccatttaaaggtggacaaaagctacctccctaaaagtaaatacaaagagaacttatttacacagggaaggtttaagactgttcaagtagcattccaatctgtagccatgccacagaatatcaacaagaacacagaatgagtgcacagctaagagatcaagtttcagcaggcagctttatctcaacctggacatattttaagattcagcatttgaaagatttccctagcctcttcctttttcattagcccaaaacggtgcaactctattctggactttattacttgattctgtcttctgtataactctgaagtccaccaaaagtggaccctctatatttcctccctttttatagtcttataagatacattatgaaaggtgaccgactctattttaaatctcagaattttaagttctagccccatgataacctttttctttgtaatttatgctttcatatatccttggtcccagagatgtttagacaattttaggctcaaaaattaaagctaacacaggaaaaggaactgtactggctattacataagaaacaatggacccaagagaagaa

SEQ ID NO: 69 - DNA, 1531 bp, Homo sapiens
acaaggactgaaccagaaggaagaggacagagcaaagccatgaacatcatcctagaaatccttctgcttctgatcaccatcatctactcctacttggagtcgttggtgaagtttttcattcctcagaggagaaaatctgtggctggggagattgttctcattactggagctgggcatggaataggcaggcagactacttatgaatttgcaaaacgacagagcatattggttctgtgggatattaataagcgcggtgtggaggaaactgcagctgagtgccgaaaactaggcgtcactgcgcatgcgtatgtggtagactgcagcaacagagaagagatctatcgctctctaaatcaggtgaagaaagaagtgggtgatgtaacaatcgtggtgaataatgctgggacagtatatccagccgatcttctcagcaccaaggatgaagagattaccaagacatttgaggtcaacatcctaggacatttttggatcacaaaagcacttcttccatcgatgatggagagaaatcatggccacatcgtcacagtggcttcagtgtgcggccacgaagggattccttacctcatcccatattgttccagcaaatttgccgctgttggctttcacagaggtctgacatcagaacttcaggccttgggaaaaactggtatcaaaacctcatgtctctgcccagtttttgtgaatactgggttcaccaaaaatccaagcacaagattatggcctgtattggagacagatgaagtcgtaagaagtctgatagatggaatacttaccaataagaaaatgatttttgttccatcgtatatcaatatctttctgagactacagaagtttcttcctgaacgcgcctcagcgattttaaatcgtatgcagaatattcaatttgaagcagtggttggccacaaaatcaaaatgaaatgaataaataagctccagccagagatgtatgcatgataatgatatgaatagtttcgaatcaatgctgcaaagctttatttcacattttttcagtcctgataatattaaaaacattggtttggcactagcagcagtcaaacgaacaagattaattacctgtcttcctgtttctcaagaatatttacgtagtttttcataggtctgtttttcctttcatgcctcttaaaaacttctgtgcttacataaacatacttaaaaggttttctttaagatattttatttttccatttaaaggtggacaaaagctacctccctaaaagtaaatacaaagagaacttatttacacagggaaggtttaagactgttcaagtagcattccaatctgtagccatgccacagaatatcaacaagaacacagaatgagtgcacagctaagagatcaagcttcagcaggcagctttatctcaacctggacatattttaagattcagcatttgaaagatttccctagcctcttcctttttcattagcccaaaacggtgcaactctattctggactttattacttgattctgtcttctgtataactctg

SEQ ID NO: 70 - DNA, 1040 bp, Homo sapiens
ggacagagcaaagccatgaacatcatcctagaaatccttctgcttctgatcaccatcatctactcctacttggagtcgttggtgaagtttttcattcctcagaggagaaaatctgtggctggggagattgttctcattactggagctgggcatggaataggcaggcagactacttatgaatttgcaaaacgacagagcatattggttctgtgggatattaataagcgcggtgtggaggaaactgcagctgagtgccgaaaactaggcgtcactgcgcatgcgtatgtggtagactgcagcaacagagaagagatctatcgctctctaaatcaggtgaagaaagaagtgggtgatgtaacaatcgtggtgaataatgctgggacagtatatccagccgatcttctcagcaccaaggatgaagagattaccaagacatttgaggtcaacatcctaggacatttttggatcacaaaagcacttcttccatcgatgatggagagaaatcatggccacatcgtcacagtggcttcagtgtgcggccacgaagggattccttacctcatcccatattgttccagcaaatttgccgctgttggctttcacagaggtctgacatcagaacttcaggccttgggaaaaactggtatcaaaacctcatgtctctgcccagtttttgtgaatactgggttcaccaaaaatccaagcacaagattatggcctgtattggagacagatgaagtcgtaagaagtctgatagatggaatacttaccaataagaaaatgatttttgttccatcgtatatcaatatctttctgagactacagaagtttcttcctgaacgcgcctcagcgattttaaatcgtatgcagaatattcaatttgaagcagtggttggccacaaaatcaaaatgaaatgaataaataagctccagccagagatgtatgcatgataatgatatgaatagtttcgaatcaatgctgcaaagctttatttcacattttttcagtcctgataatattaaaaacattggtttggcac

SEQ ID NO: 71 - DNA, 955 bp, Homo sapiens
gaaggaagaggacagagcaaagccatgaacatcatcctagaaatccttctgcttctgatcaccatcatctactcctacttggagtcgttggtgaagtttttcattcctcagaggagaaaatctgtggctggggagattgttctcattactggagctgggcatggaataggcaggcagactacttatgaatttgcaaaacgacagagcatattggttctgtgggatattaataagcgcggtgtggaggaaactgcagctgagtgccgaaaactaggcgtcactgcgcatgcgtatgtggtagactgcagcaacagagaagagatctatcgctctctaaatcaggtgaagaaagaagtgggtgatgtaacaatcgtggtgaataatgctgggacagtatatccagccgatcttctcagcaccaaggatgaagagattaccaagacatttgaggtcaacatcctaggacatttttggatcacaaaagcacttcttccatcgatgatggagagaaatcatggccacatcgtcacagtggcttcagtgtgcggccacgaagggattccttacctcatcccatattgttccagcaaatttgccgctgttggctttcacagaggtctgacatcagaacttcaggccttgggaaaaactggtatcaaaacctcatgtctctgcccagtttttgtgaatactgggttcaccaaaaatccaagcacaagattatggcctgtattggagacagatgaagtcgtaagaagtctgatagatggaatacttaccaataagaaaatgatttttgttccatcgtatatcaatatctttctgagactacagaagtttcttcctgaacgcgcctcagcgattttaaatcgtatgcagaatattcaatttgaagcagtggttggccacaaaatcaaaatgaaatgaataaataagctccagccagagatgtatg

SEQ ID NO: 72 - DNA, 2397 bp, Homo sapiens
agacagtacctcctccctaggactacacaaggactgaaccagaaggaagaggacagagcaaagccatgaacatcatcctagaaatccttctgcttctgatcaccatcatctactcctacttggagtcgttggtgaagtttttcattcctcagaggagaaaatctgtggctggggagattgttctcattactggagctgggcatggaataggcaggcagactacttatgaatttgcaaaacgacagagcatattggttctgtgggatattaataagcgcggtgtggaggaaactgcagctgagtgccgaaaactaggcgtcactgcgcatgcgtatgtggtagactgcagcaacagagaagagatctatcgctctctaaatcaggtgaagaaagaagtgggtgatgtaacaatcgtggtgaataatgctgggacagtatatccagccgatcttctcagcaccaaggatgaagagattaccaagacatttgaggtcaacatcctaggacatttttggatcacaaaagcacttcttccatcgatgatggagagaaatcatggccacatcgtcacagtggcttcagtgtgcggccacgaagggattccttacctcatcccatattgttccagcaaatttgccgctgttggctttcacagaggtctgacatcagaacttcaggccttgggaaaaactggtatcaaaacctcatgtctctgcccagtttttgtgaatactgggttcaccaaaaatccaagcacaagattatggcctgtattggagacagatgaagtcgtaagaagtctgatagatggaatacttaccaataagaaaatgatttttgttccatcgtatatcaatatctttctgagactacagaagtttcttcctgaacgcgcctcagcgattttaaatcgtatgcagaatattcaatttgaagcagtggttggccacaaaatcaaaatgaaatgaataaataagctccagccagagatgtatgcatgataatgatatgaatagtttcgaatcaatgctgcaaagctttatttcacattttttcagtcctgataatattaaaaacattggtttggcactagcagcagtcaaacgaacaagattaattacctgtcttcctgtttctcaagaatatttacgtagtttttcataggtctgtttttcctttcatgcctcttaaaaacttctgtgcttacataaacatacttaaaaggttttctttaagatattttatttttccatttaaaggtggacaaaagctacctccctaaaagtaaatacaaagagaacttatttacacagggaaggtttaagactgttcaagtagcattccaatctgtagccatgccacagaatatcaacaagaacacagaatgagtgcacagctaagagatcaagtttcagcaggcagctttatctcaacctggacatattttaagattcagcatttgaaagatttccctagcctcttcctttttcattagcccaaaacggtgcaactctattctggactttattacttgattctgtcttctgtataactctgaagtccaccaaaagtggaccctctatatttcctccctttttatagtcttataagatacattatgaaaggtgaccgactctattttaaatctcagaattttaagttctagccccatgataacctttttctttgtaatttatgctttcatatatccttggtcccagagatgtttagacaattttaggctcaaaaattaaagctaacacaggaaaaggaactgtactggctattacataagaaacaatggacccaagagaagaaaaggaagaaagaaaggttttttggtttttgttttgttttgttttgttttttgtttttttgagatggagtctcactctttcgcccaggctggagtgcagtggtatgatctcagctcactgcaagctccacctcccgggttcacgccattctcctgcctcagcctcctgagtagctgggactacaggcgcccgccaccacacccggctaattttttgtattttttgtagagacggggtttcaccatgttagccaagatggtctcgatctcctgacctcgtgatccacctgcctcggcctcccaaagtgctgggattacgggtgtgagccaccgtgcccagcctttttttttttaatagaaaaaataatccgactcccactacatcaagactaatcttgttttgtgtgtttttcacatgtattatagaatgcttttgcatggactatcctcttgtttttattaaaaacaaatgatttttttaaaagtcacaaaaacaattcactaaaaataaatatgtcattgtgctttaaaaaaataacctcttgtagttataaaataaaacgtttgacttctaaactctg

SEQ ID NO: 73 - protein, 264 aa, Homo sapiens
MNIILEILLLLITIIYSYLESLVKFFIPQRRKSVAGEIVLITGAGHGIGRQTTYEFAKRQSILVLWDINKVKKEVGDVTIVVNNAGTVYPADLLSTKDEEITKTFEVNILGHFWITKALLPSMMERNHGHIVTVASVCGHEGIPYLIPYCSSKFAAVGFHRGLTSELQALGKTGIKTSCLCPVFVNTGFTKNPSTRLWPVLETDEVVRSLIDGILTNKKMIFVPSYINIFLRLQKFLPERASAILNRMQNIQFEAVVGHKIKMK

SEQ ID NO: 74 - protein, 300 aa, Homo sapiens
MNIILEILLLLITIIYSYLESLVKFFIPQRRKSVAGEIVLITGAGHGIGRQTTYEFAKRQSILVLWDINKRGVEETAAECRKLGVTAHAYVVDCSNREEIYRSLNQVKKEVGDVTIVVNNAGTVYPADLLSTKDEEITKTFEVNILGHFWITKALLPSMMERNHGHIVTVASVCGHEGIPYLIPYCSSKFAAVGFHRGLTSELQALGKTGIKTSCLCPVFVNTGFTKNPSTRLWPVLETDEVVRSLIDGILTNKKMIFVPSYINIFLRLQKFLPERASAILNRMQNIQFEAVVGHKIKMK

SEQ ID NO: 75 - DNA, 20 bp, Artificial Sequence
  Description of Artificial Sequence: Synthetic oligonucleotide
  Synthetic sequence; PNPLA3 Guide RNA Recognition Sequence
tcggtccaaagacgaagtcg

SEQ ID NO: 76 - DNA, 20 bp, Artificial Sequence
  Description of Artificial Sequence: Synthetic oligonucleotide
  Synthetic sequence; PNPLA3 Guide RNA Recognition Sequence
ccttccgcacaagatctgag

SEQ ID NO: 77 - DNA, 20 bp, Artificial Sequence
  Description of Artificial Sequence: Synthetic oligonucleotide
  Synthetic sequence; PNPLA3 Guide RNA Recognition Sequence
tgtcgtactccccatagaag

SEQ ID NO: 78 - DNA, 20 bp, Artificial Sequence
  Description of Artificial Sequence: Synthetic oligonucleotide
  Synthetic sequence; PNPLA3 Guide RNA Recognition Sequence
atgcatccaaatatcctcga

SEQ ID NO: 79 - DNA, 20 bp, Artificial Sequence
  Description of Artificial Sequence: Synthetic oligonucleotide
  Synthetic sequence; PNPLA3 Guide RNA Recognition Sequence
acaacatgcgcgcgtcgcgg

SEQ ID NO: 80 - DNA, 20 bp, Artificial Sequence
  Description of Artificial Sequence: Synthetic oligonucleotide
  Synthetic sequence; PNPLA3 Guide RNA Recognition Sequence
ggcatttgcagagaccctgt

SEQ ID NO: 81 - DNA, 20 bp, Artificial Sequence
  Description of Artificial Sequence: Synthetic oligonucleotide
  Synthetic sequence; PNPLA3 Guide RNA Recognition Sequence
ttaagcaagttcctccgaca

SEQ ID NO: 82 - DNA, 20 bp, Artificial Sequence
  Description of Artificial Sequence: Synthetic oligonucleotide
  Synthetic sequence; PNPLA3 Guide RNA Recognition Sequence
gcgtccccagacgcacccag

SEQ ID NO: 83 - DNA, 20 bp, Artificial Sequence
  Description of Artificial Sequence: Synthetic oligonucleotide
  Synthetic sequence; PNPLA3 Guide RNA Recognition Sequence
ctcaggatccatcccttctg

SEQ ID NO: 84 - DNA, 20 bp, Artificial Sequence
  Description of Artificial Sequence: Synthetic oligonucleotide
  Synthetic sequence; PNPLA3 Guide RNA Recognition Sequence
tcttaccagagtgtctgatg

SEQ ID NO: 85 - DNA, 20 bp, Artificial Sequence
  Description of Artificial Sequence: Synthetic oligonucleotide
  Synthetic sequence; PNPLA3 Guide RNA Recognition Sequence
aagctctcgagagaaggtag

SEQ ID NO: 86 - DNA, 20 bp, Artificial Sequence
  Description of Artificial Sequence: Synthetic oligonucleotide
  Synthetic sequence; PNPLA3 Guide RNA Recognition Sequence
gcagaggcgtagactgagct

SEQ ID NO: 87 - DNA, 20 bp, Artificial Sequence
  Description of Artificial Sequence: Synthetic oligonucleotide
  Synthetic sequence; PNPLA3 Guide RNA Recognition Sequence
taaaagcgatatgtggatgg

SEQ ID NO: 88 - DNA, 20 bp, Artificial Sequence
  Description of Artificial Sequence: Synthetic oligonucleotide
  Synthetic sequence; PNPLA3 Guide RNA Recognition Sequence
cgaacaacatgcgcgcgtcg

SEQ ID NO: 89 - DNA, 20 bp, Artificial Sequence
  Description of Artificial Sequence: Synthetic oligonucleotide
  Synthetic sequence; PNPLA3 Guide RNA Recognition Sequence
ctgggagagatatgccttcg

SEQ ID NO: 90 - DNA, 20 bp, Artificial Sequence
  Description of Artificial Sequence: Synthetic oligonucleotide
  Synthetic sequence; PNPLA3 Guide RNA Recognition Sequence
aggtcctctcagatcttgtg

SEQ ID NO: 91 - DNA, 20 bp, Artificial Sequence
  Description of Artificial Sequence: Synthetic oligonucleotide
  Synthetic sequence; PNPLA3 Guide RNA Recognition Sequence
ccaactcaccttgagatccg

SEQ ID NO: 92 - DNA, 20 bp, Artificial Sequence
  Description of Artificial Sequence: Synthetic oligonucleotide
  Synthetic sequence; PNPLA3 Guide RNA Recognition Sequence
ggagatgagctggtggacat

SEQ ID NO: 93 - DNA, 20 bp, Artificial Sequence
  Description of Artificial Sequence: Synthetic oligonucleotide
  Synthetic sequence; PNPLA3 Guide RNA Recognition Sequence
tcagtctacgcctctgcaca

SEQ ID NO: 94 - DNA, 20 bp, Artificial Sequence
  Description of Artificial Sequence: Synthetic oligonucleotide
  Synthetic sequence; PNPLA3 Guide RNA Recognition Sequence
tccaggatgctctcatccca

SEQ ID NO: 95 - DNA, 20 bp, Artificial Sequence
  Description of Artificial Sequence: Synthetic oligonucleotide
  Synthetic sequence; HSD17B13 Guide RNA Recognition Sequence
agtgggtgatgtaacaatcg

SEQ ID NO: 96 - DNA, 20 bp, Artificial Sequence
  Description of Artificial Sequence: Synthetic oligonucleotide
  Synthetic sequence; HSD17B13 Guide RNA Recognition Sequence
tgaggtaaggaatcccttcg

SEQ ID NO: 97 - DNA, 20 bp, Artificial Sequence
  Description of Artificial Sequence: Synthetic oligonucleotide
  Synthetic sequence; HSD17B13 Guide RNA Recognition Sequence
acctctgtgaaagccaacag

SEQ ID NO: 98 - DNA, 20 bp, Artificial Sequence
  Description of Artificial Sequence: Synthetic oligonucleotide
  Synthetic sequence; HSD17B13 Guide RNA Recognition Sequence
ttcctaattacagcgcggtg

SEQ ID NO: 99 - DNA, 20 bp, Artificial Sequence
  Description of Artificial Sequence: Synthetic oligonucleotide
  Synthetic sequence; HSD17B13 Guide RNA Recognition Sequence
acatttgaggtcaacatcct

SEQ ID NO: 100 - DNA, 20 bp, Artificial Sequence
  Description of Artificial Sequence: Synthetic oligonucleotide
  Synthetic sequence; HSD17B13 Guide RNA Recognition Sequence
cactcacccaaaaatgtcct

SEQ ID NO: 101 - DNA, 20 bp, Artificial Sequence
  Description of Artificial Sequence: Synthetic oligonucleotide
  Synthetic sequence; HSD17B13 Guide RNA Recognition Sequence
caatcgtggtgaataatgct

SEQ ID NO: 102 - DNA, 20 bp, Artificial Sequence
  Description of Artificial Sequence: Synthetic oligonucleotide
  Synthetic sequence; HSD17B13 Guide RNA Recognition Sequence
cttcaccaacgactccaagt

SEQ ID NO: 103 - DNA, 20 bp, Artificial Sequence
  Description of Artificial Sequence: Synthetic oligonucleotide
  Synthetic sequence; HSD17B13 Guide RNA Recognition Sequence
atacttaccaatatgggatg

SEQ ID NO: 104 - DNA, 20 bp, Artificial Sequence
  Description of Artificial Sequence: Synthetic oligonucleotide
  Synthetic sequence; HSD17B13 Guide RNA Recognition Sequence
cgtcactgcgcatgcgtatg

SEQ ID NO: 105 - DNA, 20 bp, Artificial Sequence
  Description of Artificial Sequence: Synthetic oligonucleotide
  Synthetic sequence; HSD17B13 Guide RNA Recognition Sequence
agccgatcttctcagcacca

SEQ ID NO: 106 - DNA, 20 bp, Artificial Sequence
  Description of Artificial Sequence: Synthetic oligonucleotide
  Synthetic sequence; HSD17B13 Guide RNA Recognition Sequence
acagagcatattggttctgt

SEQ ID NO: 107 - DNA, 20 bp, Artificial Sequence
  Description of Artificial Sequence: Synthetic oligonucleotide
  Synthetic sequence; HSD17B13 Guide RNA Recognition Sequence
gagctgggcatggaataggc

SEQ ID NO: 108 - DNA, 20 bp, Artificial Sequence
  Description of Artificial Sequence: Synthetic oligonucleotide
  Synthetic sequence; HSD17B13 Guide RNA Recognition Sequence
ctgaagccactgtgacgatg

SEQ ID NO: 109 - DNA, 20 bp, Artificial Sequence
  Description of Artificial Sequence: Synthetic oligonucleotide
  Synthetic sequence; HSD17B13 Guide RNA Recognition Sequence
gcagctgagtgccgaaaact

SEQ ID NO: 110 - DNA, 20 bp, Artificial Sequence
  Description of Artificial Sequence: Synthetic oligonucleotide
  Synthetic sequence; HSD17B13 Guide RNA Recognition Sequence
agcacttcttccatcgatga

SEQ ID NO: 111 - DNA, 20 bp, Artificial Sequence
  Description of Artificial Sequence: Synthetic oligonucleotide
  Synthetic sequence; HSD17B13 Guide RNA Recognition Sequence
cttcagtgtgcggccacgaa

SEQ ID NO: 112 - DNA, 20 bp, Artificial Sequence
  Description of Artificial Sequence: Synthetic oligonucleotide
  Synthetic sequence; HSD17B13 Guide RNA Recognition Sequence
agaggagaaaatctgtggct

SEQ ID NO: 113 - DNA, 20 bp, Artificial Sequence
  Description of Artificial Sequence: Synthetic oligonucleotide
  Synthetic sequence; HSD17B13 Guide RNA Recognition Sequence
tcctcagaggagaaaatctg

SEQ ID NO: 114 - DNA, 20 bp, Artificial Sequence
  Description of Artificial Sequence: Synthetic oligonucleotide
  Synthetic sequence; HSD17B13 Guide RNA Recognition Sequence
gatgttgacctcaaatgtct

SEQ ID NO: 115 - RNA, 20 nt, Artificial Sequence
  Description of Artificial Sequence: Synthetic oligonucleotide
accacgcagucaaccuucug

SEQ ID NO: 116 - RNA, 20 nt, Artificial Sequence
  Description of Artificial Sequence: Synthetic oligonucleotide
uaccacgcagucaaccuucu

SEQ ID NO: 117 - RNA, 20 nt, Artificial Sequence
  Description of Artificial Sequence: Synthetic oligonucleotide
cuaccacgcagucaaccuuc

SEQ ID NO: 118 - RNA, 20 nt, Artificial Sequence
  Description of Artificial Sequence: Synthetic oligonucleotide
ccuaccacgcagucaaccuu

SEQ ID NO: 119 - RNA, 20 nt, Artificial Sequence
  Description of Artificial Sequence: Synthetic oligonucleotide
cccuaccacgcagucaaccu

SEQ ID NO: 120 - RNA, 20 nt, Artificial Sequence
  Description of Artificial Sequence: Synthetic oligonucleotide
uugccuucggcuugcucugg

SEQ ID NO: 121 - RNA, 20 nt, Artificial Sequence
  Description of Artificial Sequence: Synthetic oligonucleotide
cuugccuucggcuugcucug

SEQ ID NO: 122 - RNA, 20 nt, Artificial Sequence
  Description of Artificial Sequence: Synthetic oligonucleotide
gcuugccuucggcuugcucu

SEQ ID NO: 123 - RNA, 20 nt, Artificial Sequence
  Description of Artificial Sequence: Synthetic oligonucleotide
ugcuugccuucggcuugcuc

SEQ ID NO: 124 - RNA, 20 nt, Artificial Sequence
  Description of Artificial Sequence: Synthetic oligonucleotide
gugcuugccuucggcuugcu

SEQ ID NO: 125 - RNA, 20 nt, Artificial Sequence
  Description of Artificial Sequence: Synthetic oligonucleotide
ucgugcuugccuucggcuug

SEQ ID NO: 126 - RNA, 20 nt, Artificial Sequence
  Description of Artificial Sequence: Synthetic oligonucleotide
aucgugcuugccuucggcuu

SEQ ID NO: 127 - RNA, 20 nt, Artificial Sequence
  Description of Artificial Sequence: Synthetic oligonucleotide
caucgugcuugccuucggcu

SEQ ID NO: 128 - RNA, 20 nt, Artificial Sequence
  Description of Artificial Sequence: Synthetic oligonucleotide
agcgccaucgugcuugccuu

SEQ ID NO: 129 - RNA, 20 nt, Artificial Sequence
  Description of Artificial Sequence: Synthetic oligonucleotide
uggugagcgccaucgugcuu

SEQ ID NO: 130 - RNA, 20 nt, Artificial Sequence
  Description of Artificial Sequence: Synthetic oligonucleotide
cugaugcucggcugcuacag

SEQ ID NO: 131 - RNA, 20 nt, Artificial Sequence
  Description of Artificial Sequence: Synthetic oligonucleotide
gcugaugcucggcugcuaca

SEQ ID NO: 132 - RNA, 20 nt, Artificial Sequence
  Description of Artificial Sequence: Synthetic oligonucleotide
uuucgggcugaugcucggcu

SEQ ID NO: 133 - RNA, 20 nt, Artificial Sequence
  Description of Artificial Sequence: Synthetic oligonucleotide
uccuuucgggcugaugcucg

SEQ ID NO: 134 - RNA, 20 nt, Artificial Sequence
  Description of Artificial Sequence: Synthetic oligonucleotide
uuccuuucgggcugaugcuc

SEQ ID NO: 135 - RNA, 20 nt, Artificial Sequence
  Description of Artificial Sequence: Synthetic oligonucleotide
cuuccuuucgggcugaugcu

SEQ ID NO: 136 - RNA, 20 nt, Artificial Sequence
  Description of Artificial Sequence: Synthetic oligonucleotide
gcuuccuuucgggcugaugc

SEQ ID NO: 137 - RNA, 20 nt, Artificial Sequence
  Description of Artificial Sequence: Synthetic oligonucleotide
ugcuuccuuucgggcugaug

SEQ ID NO: 138 - RNA, 20 nt, Artificial Sequence
  Description of Artificial Sequence: Synthetic oligonucleotide
gugcuuccuuucgggcugau

SEQ ID NO: 139 - RNA, 20 nt, Artificial Sequence
  Description of Artificial Sequence: Synthetic oligonucleotide
cgugcuuccuuucgggcuga

SEQ ID NO: 140 - RNA, 20 nt, Artificial Sequence
  Description of Artificial Sequence: Synthetic oligonucleotide
ucgugcuuccuuucgggcug

SEQ ID NO: 141 - RNA, 20 nt, Artificial Sequence
  Description of Artificial Sequence: Synthetic oligonucleotide
uucgugcuuccuuucgggcu

SEQ ID NO: 142 - RNA, 20 nt, Artificial Sequence
  Description of Artificial Sequence: Synthetic oligonucleotide
uuucgugcuuccuuucgggc

SEQ ID NO: 143 - RNA, 20 nt, Artificial Sequence
  Description of Artificial Sequence: Synthetic oligonucleotide
cuuucgugcuuccuuucggg

SEQ ID NO: 144 - RNA, 20 nt, Artificial Sequence
  Description of Artificial Sequence: Synthetic oligonucleotide
gcuuucgugcuuccuuucgg

SEQ ID NO: 145 - RNA, 20 nt, Artificial Sequence
  Description of Artificial Sequence: Synthetic oligonucleotide
auguacgccagcgugcugcu

SEQ ID NO: 146 - RNA, 20 nt, Artificial Sequence
  Description of Artificial Sequence: Synthetic oligonucleotide
ucagcauguacgccagcgug

SEQ ID NO: 147 - RNA, 20 nt, Artificial Sequence
  Description of Artificial Sequence: Synthetic oligonucleotide
aggcgguguacuacgugugc

SEQ ID NO: 148 - RNA, 20 nt, Artificial Sequence
  Description of Artificial Sequence: Synthetic oligonucleotide
aaggcgguguacuacgugug

SEQ ID NO: 149 - RNA, 20 nt, Artificial Sequence
  Description of Artificial Sequence: Synthetic oligonucleotide
caaggcgguguacuacgugu

SEQ ID NO: 150 - RNA, 20 nt, Artificial Sequence
  Description of Artificial Sequence: Synthetic oligonucleotide
gcaaggcgguguacuacgug

SEQ ID NO: 151 - RNA, 20 nt, Artificial Sequence
  Description of Artificial Sequence: Synthetic oligonucleotide
ugcaaggcgguguacuacgu

SEQ ID NO: 152 - RNA, 20 nt, Artificial Sequence
  Description of Artificial Sequence: Synthetic oligonucleotide
cugcaaggcgguguacuacg

SEQ ID NO: 153 - RNA, 20 nt, Artificial Sequence
  Description of Artificial Sequence: Synthetic oligonucleotide
gcugcaaggcgguguacuac

SEQ ID NO: 154 - RNA, 20 nt, Artificial Sequence
  Description of Artificial Sequence: Synthetic oligonucleotide
ggcugcaaggcgguguacua

SEQ ID NO: 155 - RNA, 20 nt, Artificial Sequence
  Description of Artificial Sequence: Synthetic oligonucleotide
gcucuuuguggccuuccuga

SEQ ID NO: 156 - RNA, 20 nt, Artificial Sequence
  Description of Artificial Sequence: Synthetic oligonucleotide
cgcucuuuguggccuuccug

SEQ ID NO: 157 - RNA, 20 nt, Artificial Sequence
  Description of Artificial Sequence: Synthetic oligonucleotide
cuucgugguguggagcuugg

SEQ ID NO: 158 - RNA, 20 nt, Artificial Sequence
  Description of Artificial Sequence: Synthetic oligonucleotide
ggcuucgugguguggagcuu

SEQ ID NO: 159 - RNA, 20 nt, Artificial Sequence
  Description of Artificial Sequence: Synthetic oligonucleotide
caacggcuucguggugugga

SEQ ID NO: 160 - RNA, 20 nt, Artificial Sequence
  Description of Artificial Sequence: Synthetic oligonucleotide
uggcaacggcuucguggugu

SEQ ID NO: 161 - RNA, 20 nt, Artificial Sequence
  Description of Artificial Sequence: Synthetic oligonucleotide
ugagcuggaagacuucgcgg

SEQ ID NO: 162 - RNA, 20 nt, Artificial Sequence
  Description of Artificial Sequence: Synthetic oligonucleotide
cugagcuggaagacuucgcg

SEQ ID NO: 163 - RNA, 20 nt, Artificial Sequence
  Description of Artificial Sequence: Synthetic oligonucleotide
gcugagcuggaagacuucgc

SEQ ID NO: 164 - RNA, 20 nt, Artificial Sequence
  Description of Artificial Sequence: Synthetic oligonucleotide
acacugcugagcuggaagac

SEQ ID NO: 165 - RNA, 20 nt, Artificial Sequence
  Description of Artificial Sequence: Synthetic oligonucleotide
cgagacacugcugagcugga

SEQ ID NO: 166 - RNA, 20 nt, Artificial Sequence
  Description of Artificial Sequence: Synthetic oligonucleotide
acgagacacugcugagcugg

SEQ ID NO: 167 - RNA, 20 nt, Artificial Sequence
  Description of Artificial Sequence: Synthetic oligonucleotide
aacgagacacugcugagcug

SEQ ID NO: 168 - RNA, 20 nt, Artificial Sequence
  Description of Artificial Sequence: Synthetic oligonucleotide
gaacgagacacugcugagcu

SEQ ID NO: 169 - RNA, 20 nt, Artificial Sequence
  Description of Artificial Sequence: Synthetic oligonucleotide
ggaacgagacacugcugagc

SEQ ID NO: 170 - RNA, 20 nt, Artificial Sequence
  Description of Artificial Sequence: Synthetic oligonucleotide
gggaacgagacacugcugag

SEQ ID NO: 171 - RNA, 20 nt, Artificial Sequence
  Description of Artificial Sequence: Synthetic oligonucleotide
agggaacgagacacugcuga

SEQ ID NO: 172 - RNA, 20 nt, Artificial Sequence
  Description of Artificial Sequence: Synthetic oligonucleotide
cagggaacgagacacugcug

SEQ ID NO: 173 - RNA, 20 nt, Artificial Sequence
  Description of Artificial Sequence: Synthetic oligonucleotide
ccagggaacgagacacugcu

SEQ ID NO: 174 - RNA, 20 nt, Artificial Sequence
  Description of Artificial Sequence: Synthetic oligonucleotide
aaggaugucggucugcuacc

SEQ ID NO: 175 - RNA, 20 nt, Artificial Sequence
  Description of Artificial Sequence: Synthetic oligonucleotide
gaaggaugucggucugcuac

SEQ ID NO: 176 - RNA, 20 nt, Artificial Sequence
  Description of Artificial Sequence: Synthetic oligonucleotide
agaaggaugucggucugcua

SEQ ID NO: 177 - RNA, 20 nt, Artificial Sequence
  Description of Artificial Sequence: Synthetic oligonucleotide
uaggcccagaaggaugucgg

SEQ ID NO: 178 - RNA, 20 nt, Artificial Sequence
  Description of Artificial Sequence: Synthetic oligonucleotide
guaggcccagaaggaugucg

SEQ ID NO: 179 - RNA, 20 nt, Artificial Sequence
  Description of Artificial Sequence: Synthetic oligonucleotide
uguaggcccagaaggauguc

SEQ ID NO: 180 - RNA, 20 nt, Artificial Sequence
  Description of Artificial Sequence: Synthetic oligonucleotide
cuguaggcccagaaggaugu

SEQ ID NO: 181 - RNA, 20 nt, Artificial Sequence
  Description of Artificial Sequence: Synthetic oligonucleotide
ccuguaggcccagaaggaug

SEQ ID NO: 182 - RNA, 20 nt, Artificial Sequence
  Description of Artificial Sequence: Synthetic oligonucleotide
accuguaggcccagaaggau

SEQ ID NO: 183 - RNA, 20 nt, Artificial Sequence
  Description of Artificial Sequence: Synthetic oligonucleotide
cuucucaucgggcaucacag

SEQ ID NO: 184 - RNA, 20 nt, Artificial Sequence
  Description of Artificial Sequence: Synthetic oligonucleotide
ccuucucaucgggcaucaca

SEQ ID NO: 185 - RNA, 20 nt, Artificial Sequence
  Description of Artificial Sequence: Synthetic oligonucleotide
accuucucaucgggcaucac

SEQ ID NO: 186 - RNA, 20 nt, Artificial Sequence
  Description of Artificial Sequence: Synthetic oligonucleotide
caccuucucaucgggcauca

SEQ ID NO: 187 - RNA, 20 nt, Artificial Sequence
  Description of Artificial Sequence: Synthetic oligonucleotide
gcaccuucucaucgggcauc

SEQ ID NO: 188 - RNA, 20 nt, Artificial Sequence
  Description of Artificial Sequence: Synthetic oligonucleotide
ggcaccuucucaucgggcau

SEQ ID NO: 189 - RNA, 20 nt, Artificial Sequence
  Description of Artificial Sequence: Synthetic oligonucleotide
uggcaccuucucaucgggca

SEQ ID NO: 190 - RNA, 20 nt, Artificial Sequence
  Description of Artificial Sequence: Synthetic oligonucleotide
auggcaccuucucaucgggc

SEQ ID NO: 191 - RNA, 20 nt, Artificial Sequence
  Description of Artificial Sequence: Synthetic oligonucleotide
cauggcaccuucucaucggg

SEQ ID NO: 192 - RNA, 20 nt, Artificial Sequence
  Description of Artificial Sequence: Synthetic oligonucleotide
gcauggcaccuucucaucgg

SEQ ID NO: 193 - RNA, 20 nt, Artificial Sequence
  Description of Artificial Sequence: Synthetic oligonucleotide
ggcauggcaccuucucaucg

SEQ ID NO: 194 - RNA, 20 nt, Artificial Sequence
  Description of Artificial Sequence: Synthetic oligonucleotide
gaggcauggcaccuucucau

SEQ ID NO: 195 - RNA, 20 nt, Artificial Sequence
  Description of Artificial Sequence: Synthetic oligonucleotide
ggaggcauggcaccuucuca

SEQ ID NO: 196 - RNA, 20 nt, Artificial Sequence
  Description of Artificial Sequence: Synthetic oligonucleotide
gacucccaggcagaaaagag

SEQ ID NO: 197 - RNA, 20 nt, Artificial Sequence
  Description of Artificial Sequence: Synthetic oligonucleotide
ggacucccaggcagaaaaga

SEQ ID NO: 198 - RNA, 20 nt, Artificial Sequence
  Description of Artificial Sequence: Synthetic oligonucleotide
aggacucccaggcagaaaag

SEQ ID NO: 199 - RNA, 20 nt, Artificial Sequence
  Description of Artificial Sequence: Synthetic oligonucleotide
ucaggacucccaggcagaaa

SEQ ID NO: 200 - RNA, 20 nt, Artificial Sequence
  Description of Artificial Sequence: Synthetic oligonucleotide
gaagucaggacucccaggca

SEQ ID NO: 201 - RNA, 20 nt, Artificial Sequence
  Description of Artificial Sequence: Synthetic oligonucleotide
guggaagucaggacucccag

SEQ ID NO: 202 - RNA, 20 nt, Artificial Sequence
  Description of Artificial Sequence: Synthetic oligonucleotide
ucguggaagucaggacuccc

SEQ ID NO: 203 - RNA, 20 nt, Artificial Sequence
  Description of Artificial Sequence: Synthetic oligonucleotide
cucguggaagucaggacucc

SEQ ID NO: 204 - RNA, 20 nt, Artificial Sequence
  Description of Artificial Sequence: Synthetic oligonucleotide
ccucguggaagucaggacuc

SEQ ID NO: 205 - RNA, 20 nt, Artificial Sequence
  Description of Artificial Sequence: Synthetic oligonucleotide
uggguccucguggaagucag

SEQ ID NO: 206 - RNA, 20 nt, Artificial Sequence
  Description of Artificial Sequence: Synthetic oligonucleotide
cuggguccucguggaaguca

SEQ ID NO: 207 - RNA, 20 nt, Artificial Sequence
  Description of Artificial Sequence: Synthetic oligonucleotide
ucuggguccucguggaaguc

SEQ ID NO: 208 - RNA, 20 nt, Artificial Sequence
  Description of Artificial Sequence: Synthetic oligonucleotide
gucuggguccucguggaagu

SEQ ID NO: 209 - RNA, 20 nt, Artificial Sequence
  Description of Artificial Sequence: Synthetic oligonucleotide
aagaaggaguuguguuugag

SEQ ID NO: 210 - RNA, 20 nt, Artificial Sequence
  Description of Artificial Sequence: Synthetic oligonucleotide
ccaagaaggaguuguguuug

SEQ ID NO: 211 - RNA, 20 nt, Artificial Sequence
  Description of Artificial Sequence: Synthetic oligonucleotide
guuccaagaaggaguugugu

SEQ ID NO: 212 - RNA, 20 nt, Artificial Sequence
  Description of Artificial Sequence: Synthetic oligonucleotide
gguuccaagaaggaguugug

SEQ ID NO: 213 - RNA, 20 nt, Artificial Sequence
  Description of Artificial Sequence: Synthetic oligonucleotide
caggucaacugacugggagc

SEQ ID NO: 214 - RNA, 20 nt, Artificial Sequence
  Description of Artificial Sequence: Synthetic oligonucleotide
ugccuguuuaccacugagcu

SEQ ID NO: 215 - RNA, 20 nt, Artificial Sequence
  Description of Artificial Sequence: Synthetic oligonucleotide
augccuguuuaccacugagc

SEQ ID NO: 216 - RNA, 20 nt, Artificial Sequence
  Description of Artificial Sequence: Synthetic oligonucleotide
uaugccuguuuaccacugag

SEQ ID NO: 217 - RNA, 20 nt, Artificial Sequence
  Description of Artificial Sequence: Synthetic oligonucleotide
uuaugccuguuuaccacuga

SEQ ID NO: 218 - RNA, 20 nt, Artificial Sequence
  Description of Artificial Sequence: Synthetic oligonucleotide
uuuaugccuguuuaccacug

SEQ ID NO: 219 - RNA, 20 nt, Artificial Sequence
  Description of Artificial Sequence: Synthetic oligonucleotide
cuuuaugccuguuuaccacu

SEQ ID NO: 220 - RNA, 20 nt, Artificial Sequence
  Description of Artificial Sequence: Synthetic oligonucleotide
acuuuaugccuguuuaccac

SEQ ID NO: 221 - RNA, 20 nt, Artificial Sequence
  Description of Artificial Sequence: Synthetic oligonucleotide
uagagauagugacagccugg

SEQ ID NO: 222 - RNA, 20 nt, Artificial Sequence
  Description of Artificial Sequence: Synthetic oligonucleotide
guagagauagugacagccug

SEQ ID NO: 223 - RNA, 20 nt, Artificial Sequence
  Description of Artificial Sequence: Synthetic oligonucleotide
uggugguagagauagugaca

SEQ ID NO: 224 - RNA, 20 nt, Artificial Sequence
  Description of Artificial Sequence: Synthetic oligonucleotide
guggugguagagauagugac

SEQ ID NO: 225 - RNA, 20 nt, Artificial Sequence
  Description of Artificial Sequence: Synthetic oligonucleotide
uagaggaguggugguagaga

SEQ ID NO: 226 - RNA, 20 nt, Artificial Sequence
  Description of Artificial Sequence: Synthetic oligonucleotide
acuagaggaguggugguaga

SEQ ID NO: 227 - RNA, 20 nt, Artificial Sequence
  Description of Artificial Sequence: Synthetic oligonucleotide
agacuagaggagugguggua

SEQ ID NO: 228 - RNA, 20 nt, Artificial Sequence
  Description of Artificial Sequence: Synthetic oligonucleotide
cagacuagaggagugguggu

SEQ ID NO: 229 - RNA, 20 nt, Artificial Sequence
  Description of Artificial Sequence: Synthetic oligonucleotide
ccagacuagaggaguggugg

SEQ ID NO: 230 - RNA, 20 nt, Artificial Sequence
  Description of Artificial Sequence: Synthetic oligonucleotide
gccagacuagaggaguggug

SEQ ID NO: 231 - RNA, 20 nt, Artificial Sequence
  Description of Artificial Sequence: Synthetic oligonucleotide
ggccagacuagaggaguggu

SEQ ID NO: 232 - RNA, 20 nt, Artificial Sequence
  Description of Artificial Sequence: Synthetic oligonucleotide
gcccagaugugcuagaaugg

SEQ ID NO: 233 - RNA, 20 nt, Artificial Sequence
  Description of Artificial Sequence: Synthetic oligonucleotide
ugcccagaugugcuagaaug

SEQ ID NO: 234 - RNA, 20 nt, Artificial Sequence
  Description of Artificial Sequence: Synthetic oligonucleotide
uugcccagaugugcuagaau

SEQ ID NO: 235 - RNA, 20 nt, Artificial Sequence
  Description of Artificial Sequence: Synthetic oligonucleotide
uuugcccagaugugcuagaa

SEQ ID NO: 236 - RNA, 20 nt, Artificial Sequence
  Description of Artificial Sequence: Synthetic oligonucleotide
uuuugcccagaugugcuaga

SEQ ID NO: 237 - RNA, 20 nt, Artificial Sequence
  Description of Artificial Sequence: Synthetic oligonucleotide
ccaguuuugcccagaugugc

SEQ ID NO: 238 - RNA, 20 nt, Artificial Sequence
  Description of Artificial Sequence: Synthetic oligonucleotide
auccaguuuugcccagaugu

SEQ ID NO: 239 - RNA, 20 nt, Artificial Sequence
  Description of Artificial Sequence: Synthetic oligonucleotide
ccauccaguuuugcccagau

SEQ ID NO: 240 - RNA, 20 nt, Artificial Sequence
  Description of Artificial Sequence: Synthetic oligonucleotide
caccauccaguuuugcccag

SEQ ID NO: 241 - RNA, 20 nt, Artificial Sequence
  Description of Artificial Sequence: Synthetic oligonucleotide
ccaccauccaguuuugccca

SEQ ID NO: 242 - RNA, 20 nt, Artificial Sequence
  Description of Artificial Sequence: Synthetic oligonucleotide
cccaccauccaguuuugccc

SEQ ID NO: 243 - RNA, 20 nt, Artificial Sequence
  Description of Artificial Sequence: Synthetic oligonucleotide
uugcucccagcuugguaagu

SEQ ID NO: 244 - RNA, 20 nt, Artificial Sequence
  Description of Artificial Sequence: Synthetic oligonucleotide
gcuugcucccagcuugguaa

SEQ ID NO: 245 - RNA, 20 nt, Artificial Sequence
  Description of Artificial Sequence: Synthetic oligonucleotide
auccugcuugcucccagcuu

SEQ ID NO: 246 - RNA, 20 nt, Artificial Sequence
  Description of Artificial Sequence: Synthetic oligonucleotide
aauccugcuugcucccagcu

SEQ ID NO: 247 - RNA, 20 nt, Artificial Sequence
  Description of Artificial Sequence: Synthetic oligonucleotide
caauccugcuugcucccagc

SEQ ID NO: 248 - RNA, 20 nt, Artificial Sequence
  Description of Artificial Sequence: Synthetic oligonucleotide
ccaauccugcuugcucccag

SEQ ID NO: 249 - RNA, 20 nt, Artificial Sequence
  Description of Artificial Sequence: Synthetic oligonucleotide
aaccuuucagcuucuccagg

SEQ ID NO: 250 - RNA, 20 nt, Artificial Sequence
  Description of Artificial Sequence: Synthetic oligonucleotide
uaaccuuucagcuucuccag

SEQ ID NO: 251 - RNA, 20 nt, Artificial Sequence
  Description of Artificial Sequence: Synthetic oligonucleotide
uuaaccuuucagcuucucca

SEQ ID NO: 252 - RNA, 20 nt, Artificial Sequence
  Description of Artificial Sequence: Synthetic oligonucleotide
acugcugcuuaaccuuucag

SEQ ID NO: 253 - RNA, 20 nt, Artificial Sequence
  Description of Artificial Sequence: Synthetic oligonucleotide
uacugcugcuuaaccuuuca

SEQ ID NO: 254 - RNA, 20 nt, Artificial Sequence
  Description of Artificial Sequence: Synthetic oligonucleotide
cuacugcugcuuaaccuuuc

SEQ ID NO: 255 - RNA, 20 nt, Artificial Sequence
  Description of Artificial Sequence: Synthetic oligonucleotide
ccuacugcugcuuaaccuuu

SEQ ID NO: 256 - RNA, 20 nt, Artificial Sequence
  Description of Artificial Sequence: Synthetic oligonucleotide
gccuacugcugcuuaaccuu

SEQ ID NO: 257 - RNA, 20 nt, Artificial Sequence
  Description of Artificial Sequence: Synthetic oligonucleotide
caggacaggaguaggcaccu

SEQ ID NO: 258 - RNA, 20 nt, Artificial Sequence
  Description of Artificial Sequence: Synthetic oligonucleotide
acaggacaggaguaggcacc

SEQ ID NO: 259 - RNA, 20 nt, Artificial Sequence
  Description of Artificial Sequence: Synthetic oligonucleotide
gcacaggacaggaguaggca

SEQ ID NO: 260 - RNA, 20 nt, Artificial Sequence
  Description of Artificial Sequence: Synthetic oligonucleotide
auaggcacaggacaggagua

SEQ ID NO: 261 - RNA, 20 nt, Artificial Sequence
  Description of Artificial Sequence: Synthetic oligonucleotide
gauaggcacaggacaggagu

SEQ ID NO: 262 - RNA, 20 nt, Artificial Sequence
  Description of Artificial Sequence: Synthetic oligonucleotide
ugauaggcacaggacaggag

SEQ ID NO: 263 - RNA, 20 nt, Artificial Sequence
  Description of Artificial Sequence: Synthetic oligonucleotide
acccucugcaaaugugauag

SEQ ID NO: 264 - RNA, 20 nt, Artificial Sequence
  Description of Artificial Sequence: Synthetic oligonucleotide
cuuacccucugcaaauguga

SEQ ID NO: 265 - RNA, 20 nt, Artificial Sequence
  Description of Artificial Sequence: Synthetic oligonucleotide
gucuuacccucugcaaaugu

SEQ ID NO: 266 - RNA, 20 nt, Artificial Sequence
  Description of Artificial Sequence: Synthetic oligonucleotide
ugucuuacccucugcaaaug

SEQ ID NO: 267 - RNA, 20 nt, Artificial Sequence
  Description of Artificial Sequence: Synthetic oligonucleotide
uugucuuacccucugcaaau

SEQ ID NO: 268 - RNA, 20 nt, Artificial Sequence
  Description of Artificial Sequence: Synthetic oligonucleotide
cuugucuuacccucugcaaa

SEQ ID NO: 269 - RNA, 20 nt, Artificial Sequence
  Description of Artificial Sequence: Synthetic oligonucleotide
ucuugucuuacccucugcaa

SEQ ID NO: 270 - RNA, 20 nt, Artificial Sequence
  Description of Artificial Sequence: Synthetic oligonucleotide
cauucuugucuuacccucug

SEQ ID NO: 271 - RNA, 20 nt, Artificial Sequence
  Description of Artificial Sequence: Synthetic oligonucleotide
cccauucuugucuuacccuc

SEQ ID NO: 272 - RNA, 20 nt, Artificial Sequence
  Description of Artificial Sequence: Synthetic oligonucleotide
gagccucaucuugucccucc

SEQ ID NO: 273 - RNA, 20 nt, Artificial Sequence
  Description of Artificial Sequence: Synthetic oligonucleotide
ugagccucaucuugucccuc

SEQ ID NO: 274 - RNA, 20 nt, Artificial Sequence
  Description of Artificial Sequence: Synthetic oligonucleotide
ugcguuggugaugggaagga

SEQ ID NO: 275 - RNA, 20 nt, Artificial Sequence
  Description of Artificial Sequence: Synthetic oligonucleotide
gugcguuggugaugggaagg

SEQ ID NO: 276 - RNA, 20 nt, Artificial Sequence
  Description of Artificial Sequence: Synthetic oligonucleotide
ggugcguuggugaugggaag

SEQ ID NO: 277 - RNA, 20 nt, Artificial Sequence
  Description of Artificial Sequence: Synthetic oligonucleotide
gggugcguuggugaugggaa

SEQ ID NO: 278 - RNA, 20 nt, Artificial Sequence
  Description of Artificial Sequence: Synthetic oligonucleotide
ugggugcguuggugauggga

SEQ ID NO: 279 - RNA, 20 nt, Artificial Sequence
  Description of Artificial Sequence: Synthetic oligonucleotide
ucucacaugccuggacgccu

SEQ ID NO: 280 - RNA, 20 nt, Artificial Sequence
  Description of Artificial Sequence: Synthetic oligonucleotide
caaggcaggcucucacaugc

SEQ ID NO: 281 - RNA, 20 nt, Artificial Sequence
  Description of Artificial Sequence: Synthetic oligonucleotide
ugcuguuuccuggcaaggca

SEQ ID NO: 282 - RNA, 20 nt, Artificial Sequence
  Description of Artificial Sequence: Synthetic oligonucleotide
uugugcuguuuccuggcaag

SEQ ID NO: 283 - RNA, 20 nt, Artificial Sequence
  Description of Artificial Sequence: Synthetic oligonucleotide
cuugugcuguuuccuggcaa

SEQ ID NO: 284 - RNA, 20 nt, Artificial Sequence
  Description of Artificial Sequence: Synthetic oligonucleotide
accaccagggaaucuuacug

SEQ ID NO: 285 - RNA, 20 nt, Artificial Sequence
  Description of Artificial Sequence: Synthetic oligonucleotide
uccaccaccagggaaucuua

SEQ ID NO: 286 - RNA, 20 nt, Artificial Sequence
  Description of Artificial Sequence: Synthetic oligonucleotide
auuuccuuccaccaccaggg

SEQ ID NO: 287 - RNA, 20 nt, Artificial Sequence
  Description of Artificial Sequence: Synthetic oligonucleotide
uauuuccuuccaccaccagg

SEQ ID NO: 288 - RNA, 20 nt, Artificial Sequence
  Description of Artificial Sequence: Synthetic oligonucleotide
ccuauuuccuuccaccacca

SEQ ID NO: 289 - RNA, 20 nt, Artificial Sequence
  Description of Artificial Sequence: Synthetic oligonucleotide
aguccuccuauuuccuucca

SEQ ID NO: 290 - RNA, 20 nt, Artificial Sequence
  Description of Artificial Sequence: Synthetic oligonucleotide
agaguccuccuauuuccuuc

SEQ ID NO: 291 - RNA, 20 nt, Artificial Sequence
  Description of Artificial Sequence: Synthetic oligonucleotide
agcagaguccuccuauuucc

SEQ ID NO: 292 - RNA, 20 nt, Artificial Sequence
  Description of Artificial Sequence: Synthetic oligonucleotide
cagcagaguccuccuauuuc

SEQ ID NO: 293 - RNA, 20 nt, Artificial Sequence
  Description of Artificial Sequence: Synthetic oligonucleotide
auucagcagaguccuccuau

SEQ ID NO: 294 - RNA, 20 nt, Artificial Sequence
  Description of Artificial Sequence: Synthetic oligonucleotide
accaggauucagcagagucc

SEQ ID NO: 295 - RNA, 20 nt, Artificial Sequence
  Description of Artificial Sequence: Synthetic oligonucleotide
gaccaggauucagcagaguc

SEQ ID NO: 296 - RNA, 20 nt, Artificial Sequence
  Description of Artificial Sequence: Synthetic oligonucleotide
ggaccaggauucagcagagu

SEQ ID NO: 297 - RNA, 20 nt, Artificial Sequence
  Description of Artificial Sequence: Synthetic oligonucleotide
caggaccaggauucagcaga

SEQ ID NO: 298 - RNA, 20 nt, Artificial Sequence
  Description of Artificial Sequence: Synthetic oligonucleotide
cagaagcaggaccaggauuc

SEQ ID NO: 299 - RNA, 20 nt, Artificial Sequence
  Description of Artificial Sequence: Synthetic oligonucleotide
acagaagcaggaccaggauu

SEQ ID NO: 300 - RNA, 20 nt, Artificial Sequence
  Description of Artificial Sequence: Synthetic oligonucleotide
aacagaagcaggaccaggau

SEQ ID NO: 301 - RNA, 20 nt, Artificial Sequence
  Description of Artificial Sequence: Synthetic oligonucleotide
agaacagaagcaggaccagg

SEQ ID NO: 302 - RNA, 20 nt, Artificial Sequence
  Description of Artificial Sequence: Synthetic oligonucleotide
gggagggaugagaacagaag

SEQ ID NO: 303 - RNA, 20 nt, Artificial Sequence
  Description of Artificial Sequence: Synthetic oligonucleotide
caggcaacauacacacugca

SEQ ID NO: 304 - RNA, 20 nt, Artificial Sequence
  Description of Artificial Sequence: Synthetic oligonucleotide
ccaggcaacauacacacugc

SEQ ID NO: 305 - RNA, 20 nt, Artificial Sequence
  Description of Artificial Sequence: Synthetic oligonucleotide
accaggcaacauacacacug

SEQ ID NO: 306 - RNA, 20 nt, Artificial Sequence
  Description of Artificial Sequence: Synthetic oligonucleotide
agaccaggcaacauacacac

SEQ ID NO: 307 - RNA, 20 nt, Artificial Sequence
  Description of Artificial Sequence: Synthetic oligonucleotide
gagagaccaggcaacauaca

SEQ ID NO: 308 - RNA, 20 nt, Artificial Sequence
  Description of Artificial Sequence: Synthetic oligonucleotide
ccagagagaccaggcaacau

SEQ ID NO: 309 - RNA, 20 nt, Artificial Sequence
  Description of Artificial Sequence: Synthetic oligonucleotide
uuguuugggucaccucugca

SEQ ID NO: 310 - RNA, 20 nt, Artificial Sequence
  Description of Artificial Sequence: Synthetic oligonucleotide
guuguuugggucaccucugc

SEQ ID NO: 311 - RNA, 20 nt, Artificial Sequence
  Description of Artificial Sequence: Synthetic oligonucleotide
aguuguuugggucaccucug

SEQ ID NO: 312 - RNA, 20 nt, Artificial Sequence
  Description of Artificial Sequence: Synthetic oligonucleotide
ugaguuguuugggucaccuc

SEQ ID NO: 313 - RNA, 20 nt, Artificial Sequence
  Description of Artificial Sequence: Synthetic oligonucleotide
cugaguuguuugggucaccu

SEQ ID NO: 314 - RNA, 20 nt, Artificial Sequence
  Description of Artificial Sequence: Synthetic oligonucleotide
gacugaguuguuugggucac

SEQ ID NO: 315 - RNA, 20 nt, Artificial Sequence
  Description of Artificial Sequence: Synthetic oligonucleotide
aaacaggcaaggauaaggca

SEQ ID NO: 316 - RNA, 20 nt, Artificial Sequence
  Description of Artificial Sequence: Synthetic oligonucleotide
acauggaaaagcugucauug

SEQ ID NO: 317 - RNA, 20 nt, Artificial Sequence
  Description of Artificial Sequence: Synthetic oligonucleotide
ccuuacauggaaaagcuguc

SEQ ID NO: 318 - RNA, 20 nt, Artificial Sequence
  Description of Artificial Sequence: Synthetic oligonucleotide
gccuuacauggaaaagcugu

SEQ ID NO: 319 - RNA, 20 nt, Artificial Sequence
  Description of Artificial Sequence: Synthetic oligonucleotide
cuccuggaaccuagcaccau

SEQ ID NO: 320 - RNA, 20 nt, Artificial Sequence
  Description of Artificial Sequence: Synthetic oligonucleotide
ccuccuggaaccuagcacca

SEQ ID NO: 321 - RNA, 20 nt, Artificial Sequence
  Description of Artificial Sequence: Synthetic oligonucleotide
uccuccuggaaccuagcacc

SEQ ID NO: 322 - RNA, 20 nt, Artificial Sequence
  Description of Artificial Sequence: Synthetic oligonucleotide
aaccauuaugccuccaugca

SEQ ID NO: 323 - RNA, 20 nt, Artificial Sequence
  Description of Artificial Sequence: Synthetic oligonucleotide
uaaccauuaugccuccaugc

SEQ ID NO: 324 - RNA, 20 nt, Artificial Sequence
  Description of Artificial Sequence: Synthetic oligonucleotide
cuaaccauuaugccuccaug

SEQ ID NO: 325 - RNA, 20 nt, Artificial Sequence
  Description of Artificial Sequence: Synthetic oligonucleotide
ccuaaccauuaugccuccau

SEQ ID NO: 326 - RNA, 20 nt, Artificial Sequence
  Description of Artificial Sequence: Synthetic oligonucleotide
cccuaaccauuaugccucca

SEQ ID NO: 327 - RNA, 20 nt, Artificial Sequence
  Description of Artificial Sequence: Synthetic oligonucleotide
acucccuaaccauuaugccu

SEQ ID NO: 328 - RNA, 20 nt, Artificial Sequence
  Description of Artificial Sequence: Synthetic oligonucleotide
gacucccuaaccauuaugcc

SEQ ID NO: 329 - RNA, 20 nt, Artificial Sequence
  Description of Artificial Sequence: Synthetic oligonucleotide
ugacucccuaaccauuaugc

SEQ ID NO: 330 - RNA, 20 nt, Artificial Sequence
  Description of Artificial Sequence: Synthetic oligonucleotide
augacucccuaaccauuaug

SEQ ID NO: 331 - RNA, 20 nt, Artificial Sequence
  Description of Artificial Sequence: Synthetic oligonucleotide
caugacucccuaaccauuau

SEQ ID NO: 332 - RNA, 20 nt, Artificial Sequence
  Description of Artificial Sequence: Synthetic oligonucleotide
gggccucuucaugguugugu

SEQ ID NO: 333 - RNA, 20 nt, Artificial Sequence
  Description of Artificial Sequence: Synthetic oligonucleotide
uggugcagccugguaauggg

SEQ ID NO: 334 - RNA, 20 nt, Artificial Sequence
  Description of Artificial Sequence: Synthetic oligonucleotide
cuggugcagccugguaaugg

SEQ ID NO: 335 - RNA, 20 nt, Artificial Sequence
  Description of Artificial Sequence: Synthetic oligonucleotide
ccuggugcagccugguaaug

SEQ ID NO: 336 - RNA, 20 nt, Artificial Sequence
  Description of Artificial Sequence: Synthetic oligonucleotide
auccuggugcagccugguaa

SEQ ID NO: 337 - RNA, 20 nt, Artificial Sequence
  Description of Artificial Sequence: Synthetic oligonucleotide
uauccuggugcagccuggua

SEQ ID NO: 338 - RNA, 20 nt, Artificial Sequence
  Description of Artificial Sequence: Synthetic oligonucleotide
guauccuggugcagccuggu

SEQ ID NO: 339 - RNA, 20 nt, Artificial Sequence
  Description of Artificial Sequence: Synthetic oligonucleotide
uguauccuggugcagccugg

SEQ ID NO: 340 - RNA, 20 nt, Artificial Sequence
  Description of Artificial Sequence: Synthetic oligonucleotide
ucuuguauccuggugcagcc

SEQ ID NO: 341 - RNA, 20 nt, Artificial Sequence
  Description of Artificial Sequence: Synthetic oligonucleotide
gucuuguauccuggugcagc

SEQ ID NO: 342 - RNA, 20 nt, Artificial Sequence
  Description of Artificial Sequence: Synthetic oligonucleotide
ugucuuguauccuggugcag

SEQ ID NO: 343 - RNA, 20 nt, Artificial Sequence
  Description of Artificial Sequence: Synthetic oligonucleotide
uugucuuguauccuggugca

SEQ ID NO: 344 - RNA, 20 nt, Artificial Sequence
  Description of Artificial Sequence: Synthetic oligonucleotide
cuugucuuguauccuggugc

SEQ ID NO: 345 - RNA, 20 nt, Artificial Sequence
  Description of Artificial Sequence: Synthetic oligonucleotide
ucuugucuuguauccuggug

SEQ ID NO: 346 - RNA, 20 nt, Artificial Sequence
  Description of Artificial Sequence: Synthetic oligonucleotide
uucuugucuuguauccuggu

SEQ ID NO: 347 - RNA, 20 nt, Artificial Sequence
  Description of Artificial Sequence: Synthetic oligonucleotide
uuucuugucuuguauccugg

SEQ ID NO: 348 - RNA, 20 nt, Artificial Sequence
  Description of Artificial Sequence: Synthetic oligonucleotide
ccuuucuugucuuguauccu

SEQ ID NO: 349 - RNA, 20 nt, Artificial Sequence
  Description of Artificial Sequence: Synthetic oligonucleotide
acucauccuuuccuuucuug

SEQ ID NO: 350 - RNA, 20 nt, Artificial Sequence
  Description of Artificial Sequence: Synthetic oligonucleotide
ccuacucauccuuuccuuuc

SEQ ID NO: 351 - RNA, 20 nt, Artificial Sequence
  Description of Artificial Sequence: Synthetic oligonucleotide
cccuacucauccuuuccuuu

SEQ ID NO: 352 - RNA, 20 nt, Artificial Sequence
  Description of Artificial Sequence: Synthetic oligonucleotide
ucccuacucauccuuuccuu

SEQ ID NO: 353 - RNA, 20 nt, Artificial Sequence
  Description of Artificial Sequence: Synthetic oligonucleotide
gcuucuuaguaugucccuac

SEQ ID NO: 354 - RNA, 20 nt, Artificial Sequence
  Description of Artificial Sequence: Synthetic oligonucleotide
gcugcuucuuaguauguccc

SEQ ID NO: 355 - RNA, 20 nt, Artificial Sequence
  Description of Artificial Sequence: Synthetic oligonucleotide
ggcugcuucuuaguaugucc

SEQ ID NO: 356 - RNA, 20 nt, Artificial Sequence
  Description of Artificial Sequence: Synthetic oligonucleotide
gggcugcuucuuaguauguc

SEQ ID NO: 357 - RNA, 20 nt, Artificial Sequence
  Description of Artificial Sequence: Synthetic oligonucleotide
agggcugcuucuuaguaugu

SEQ ID NO: 358 - RNA, 20 nt, Artificial Sequence
  Description of Artificial Sequence: Synthetic oligonucleotide
gagagggcugcuucuuagua

SEQ ID NO: 359 - RNA, 20 nt, Artificial Sequence
  Description of Artificial Sequence: Synthetic oligonucleotide
uccaagaggagagggcugcu

SEQ ID NO: 360 - RNA, 20 nt, Artificial Sequence
  Description of Artificial Sequence: Synthetic oligonucleotide
uugacuuuuccaagaggaga

SEQ ID NO: 361 - RNA, 20 nt, Artificial Sequence
  Description of Artificial Sequence: Synthetic oligonucleotide
agcucuauccaucugccagg

SEQ ID NO: 362 - RNA, 20 nt, Artificial Sequence
  Description of Artificial Sequence: Synthetic oligonucleotide
gcuguuacuugagcagaggc

SEQ ID NO: 363 - RNA, 20 nt, Artificial Sequence
  Description of Artificial Sequence: Synthetic oligonucleotide
ggcuguuacuugagcagagg

SEQ ID NO: 364 - RNA, 20 nt, Artificial Sequence
  Description of Artificial Sequence: Synthetic oligonucleotide
uggcuguuacuugagcagag

SEQ ID NO: 365 - RNA, 20 nt, Artificial Sequence
  Description of Artificial Sequence: Synthetic oligonucleotide
cuggcuguuacuugagcaga

SEQ ID NO: 366 - RNA, 20 nt, Artificial Sequence
  Description of Artificial Sequence: Synthetic oligonucleotide
ucuggcuguuacuugagcag

SEQ ID NO: 367 - RNA, 20 nt, Artificial Sequence
  Description of Artificial Sequence: Synthetic oligonucleotide
ccucaaguucuggcuguuac

SEQ ID NO: 368 - RNA, 20 nt, Artificial Sequence
  Description of Artificial Sequence: Synthetic oligonucleotide
accucaaguucuggcuguua

SEQ ID NO: 369 - RNA, 20 nt, Artificial Sequence
  Description of Artificial Sequence: Synthetic oligonucleotide
caaccucaaguucuggcugu

SEQ ID NO: 370 - RNA, 20 nt, Artificial Sequence
  Description of Artificial Sequence: Synthetic oligonucleotide
gcaaccucaaguucuggcug

SEQ ID NO: 371 - RNA, 20 nt, Artificial Sequence
  Description of Artificial Sequence: Synthetic oligonucleotide
agcaaccucaaguucuggcu

SEQ ID NO: 372 - RNA, 20 nt, Artificial Sequence
  Description of Artificial Sequence: Synthetic oligonucleotide
caagcaaccucaaguucugg

SEQ ID NO: 373 - RNA, 20 nt, Artificial Sequence
  Description of Artificial Sequence: Synthetic oligonucleotide
ccaagcaaccucaaguucug

SEQ ID NO: 374 - RNA, 20 nt, Artificial Sequence
  Description of Artificial Sequence: Synthetic oligonucleotide
cccaagcaaccucaaguucu

SEQ ID NO: 375 - RNA, 20 nt, Artificial Sequence
  Description of Artificial Sequence: Synthetic oligonucleotide
acuaagacagugcuccuggu

SEQ ID NO: 376 - RNA, 20 nt, Artificial Sequence
  Description of Artificial Sequence: Synthetic oligonucleotide
caaacuaagacagugcuccu

SEQ ID NO: 377 - RNA, 20 nt, Artificial Sequence
  Description of Artificial Sequence: Synthetic oligonucleotide
agcucugcuuuggaagaacc

SEQ ID NO: 378 - RNA, 20 nt, Artificial Sequence
  Description of Artificial Sequence: Synthetic oligonucleotide
cccuuagcucaagcucugcu

SEQ ID NO: 379 - RNA, 20 nt, Artificial Sequence
  Description of Artificial Sequence: Synthetic oligonucleotide
gcccuuagcucaagcucugc

SEQ ID NO: 380 - RNA, 20 nt, Artificial Sequence
  Description of Artificial Sequence: Synthetic oligonucleotide
aagcccuuagcucaagcucu

SEQ ID NO: 381 - RNA, 20 nt, Artificial Sequence
  Description of Artificial Sequence: Synthetic oligonucleotide
caagcccuuagcucaagcuc

SEQ ID NO: 382 - RNA, 20 nt, Artificial Sequence
  Description of Artificial Sequence: Synthetic oligonucleotide
ccaagcccuuagcucaagcu

SEQ ID NO: 383 - RNA, 20 nt, Artificial Sequence
  Description of Artificial Sequence: Synthetic oligonucleotide
cccaagcccuuagcucaagc

SEQ ID NO: 384 - RNA, 20 nt, Artificial Sequence
  Description of Artificial Sequence: Synthetic oligonucleotide
guacccaagcccuuagcuca

SEQ ID NO: 385 - RNA, 20 nt, Artificial Sequence
  Description of Artificial Sequence: Synthetic oligonucleotide
uguacccaagcccuuagcuc

SEQ ID NO: 386 - RNA, 20 nt, Artificial Sequence
  Description of Artificial Sequence: Synthetic oligonucleotide
cuguacccaagcccuuagcu

SEQ ID NO: 387 - RNA, 20 nt, Artificial Sequence
  Description of Artificial Sequence: Synthetic oligonucleotide
ccuguacccaagcccuuagc

SEQ ID NO: 388 - RNA, 20 nt, Artificial Sequence
  Description of Artificial Sequence: Synthetic oligonucleotide
accuguacccaagcccuuag

SEQ ID NO: 389 - RNA, 20 nt, Artificial Sequence
  Description of Artificial Sequence: Synthetic oligonucleotide
ucaccuguacccaagcccuu

SEQ ID NO: 390 - RNA, 20 nt, Artificial Sequence
  Description of Artificial Sequence: Synthetic oligonucleotide
aucaccuguacccaagcccu

SEQ ID NO: 391 - RNA, 20 nt, Artificial Sequence
  Description of Artificial Sequence: Synthetic oligonucleotide
ggaucaccuguacccaagcc

SEQ ID NO: 392 - RNA, 20 nt, Artificial Sequence
  Description of Artificial Sequence: Synthetic oligonucleotide
cucaagaauacaggaucacc

SEQ ID NO: 393 - RNA, 20 nt, Artificial Sequence
  Description of Artificial Sequence: Synthetic oligonucleotide
cuuagcucaagaauacagga

SEQ ID NO: 394 - RNA, 20 nt, Artificial Sequence
  Description of Artificial Sequence: Synthetic oligonucleotide
ccuuagcucaagaauacagg

SEQ ID NO: 395 - RNA, 20 nt, Artificial Sequence
  Description of Artificial Sequence: Synthetic oligonucleotide
gcccuuagcucaagaauaca

SEQ ID NO: 396 - RNA, 20 nt, Artificial Sequence
  Description of Artificial Sequence: Synthetic oligonucleotide
agcccuuagcucaagaauac

SEQ ID NO: 397 - RNA, 20 nt, Artificial Sequence
  Description of Artificial Sequence: Synthetic oligonucleotide
aagcccuuagcucaagaaua

SEQ ID NO: 398 - RNA, 20 nt, Artificial Sequence
  Description of Artificial Sequence: Synthetic oligonucleotide
caagcccuuagcucaagaau

SEQ ID NO: 399 - RNA, 20 nt, Artificial Sequence
  Description of Artificial Sequence: Synthetic oligonucleotide
ccaagcccuuagcucaagaa

SEQ ID NO: 400 - RNA, 20 nt, Artificial Sequence
  Description of Artificial Sequence: Synthetic oligonucleotide
cccaagcccuuagcucaaga

SEQ ID NO: 401 - RNA, 20 nt, Artificial Sequence
  Description of Artificial Sequence: Synthetic oligonucleotide
guacccaagcccuuagcuca

SEQ ID NO: 402 - RNA, 20 nt, Artificial Sequence
  Description of Artificial Sequence: Synthetic oligonucleotide
uguacccaagcccuuagcuc

SEQ ID NO: 403 - RNA, 20 nt, Artificial Sequence
  Description of Artificial Sequence: Synthetic oligonucleotide
cuguacccaagcccuuagcu

SEQ ID NO: 404 - RNA, 20 nt, Artificial Sequence
  Description of Artificial Sequence: Synthetic oligonucleotide
ccuguacccaagcccuuagc

SEQ ID NO: 405 - RNA, 20 nt, Artificial Sequence
  Description of Artificial Sequence: Synthetic oligonucleotide
accuguacccaagcccuuag

SEQ ID NO: 406 - RNA, 20 nt, Artificial Sequence
  Description of Artificial Sequence: Synthetic oligonucleotide
ucaccuguacccaagcccuu

SEQ ID NO: 407 - RNA, 20 nt, Artificial Sequence
  Description of Artificial Sequence: Synthetic oligonucleotide
aucaccuguacccaagcccu

SEQ ID NO: 408 - RNA, 20 nt, Artificial Sequence
  Description of Artificial Sequence: Synthetic oligonucleotide
ggaucaccuguacccaagcc

SEQ ID NO: 409 - RNA, 20 nt, Artificial Sequence
  Description of Artificial Sequence: Synthetic oligonucleotide
uaaccucccaaauacaggau

SEQ ID NO: 410 - RNA, 20 nt, Artificial Sequence
  Description of Artificial Sequence: Synthetic oligonucleotide
uaccuuaugcccucacuucc

SEQ ID NO: 411 - RNA, 20 nt, Artificial Sequence
  Description of Artificial Sequence: Synthetic oligonucleotide
uuaccuuaugcccucacuuc

SEQ ID NO: 412 - RNA, 20 nt, Artificial Sequence
  Description of Artificial Sequence: Synthetic oligonucleotide
uuuaccuuaugcccucacuu

SEQ ID NO: 413 - RNA, 20 nt, Artificial Sequence
  Description of Artificial Sequence: Synthetic oligonucleotide
uuuuaccuuaugcccucacu

SEQ ID NO: 414 - RNA, 20 nt, Artificial Sequence
  Description of Artificial Sequence: Synthetic oligonucleotide
uuguuuuaccuuaugcccuc

SEQ ID NO: 415 - RNA, 20 nt, Artificial Sequence
  Description of Artificial Sequence: Synthetic oligonucleotide
cuuguuuuaccuuaugcccu

SEQ ID NO: 416 - RNA, 20 nt, Artificial Sequence
  Description of Artificial Sequence: Synthetic oligonucleotide
uuaauggcuuuccucucucu

SEQ ID NO: 417 - RNA, 20 nt, Artificial Sequence
  Description of Artificial Sequence: Synthetic oligonucleotide
acucuuaauggcuuuccucu

SEQ ID NO: 418 - RNA, 20 nt, Artificial Sequence
  Description of Artificial Sequence: Synthetic oligonucleotide
uacucuuaauggcuuuccuc

SEQ ID NO: 419 - RNA, 20 nt, Artificial Sequence
  Description of Artificial Sequence: Synthetic oligonucleotide
cauacucuuaauggcuuucc

SEQ ID NO: 420 - RNA, 20 nt, Artificial Sequence
  Description of Artificial Sequence: Synthetic oligonucleotide
gaagggacuuaacauacucu

SEQ ID NO: 421 - RNA, 20 nt, Artificial Sequence
  Description of Artificial Sequence: Synthetic oligonucleotide
ugaagggacuuaacauacuc

SEQ ID NO: 422 - RNA, 20 nt, Artificial Sequence
  Description of Artificial Sequence: Synthetic oligonucleotide
acugaagggacuuaacauac

SEQ ID NO: 423 - RNA, 20 nt, Artificial Sequence
  Description of Artificial Sequence: Synthetic oligonucleotide
cuacugaagggacuuaacau

SEQ ID NO: 424 - RNA, 20 nt, Artificial Sequence
  Description of Artificial Sequence: Synthetic oligonucleotide
gccuacugaagggacuuaac

SEQ ID NO: 425 - RNA, 20 nt, Artificial Sequence
  Description of Artificial Sequence: Synthetic oligonucleotide
ggccuacugaagggacuuaa

SEQ ID NO: 426 - RNA, 20 nt, Artificial Sequence
  Description of Artificial Sequence: Synthetic oligonucleotide
uucucagagguucccaaggc

SEQ ID NO: 427 - RNA, 20 nt, Artificial Sequence
  Description of Artificial Sequence: Synthetic oligonucleotide
uuuucucagagguucccaag

SEQ ID NO: 428 - RNA, 20 nt, Artificial Sequence
  Description of Artificial Sequence: Synthetic oligonucleotide
acuuuucucagagguuccca

SEQ ID NO: 429 - RNA, 20 nt, Artificial Sequence
  Description of Artificial Sequence: Synthetic oligonucleotide
uacuuuucucagagguuccc

SEQ ID NO: 430 - RNA, 20 nt, Artificial Sequence
  Description of Artificial Sequence: Synthetic oligonucleotide
gggcaaucuauacuuuucuc

SEQ ID NO: 431 - RNA, 20 nt, Artificial Sequence
  Description of Artificial Sequence: Synthetic oligonucleotide
ugucuugggcaaucuauacu

SEQ ID NO: 432 - RNA, 20 nt, Artificial Sequence
  Description of Artificial Sequence: Synthetic oligonucleotide
ccagucuuuugucuugggca

SEQ ID NO: 433 - RNA, 20 nt, Artificial Sequence
  Description of Artificial Sequence: Synthetic oligonucleotide
gccagucuuuugucuugggc

SEQ ID NO: 434 - RNA, 20 nt, Artificial Sequence
  Description of Artificial Sequence: Synthetic oligonucleotide
ugccagucuuuugucuuggg

SEQ ID NO: 435 - RNA, 20 nt, Artificial Sequence
  Description of Artificial Sequence: Synthetic oligonucleotide
cugccagucuuuugucuugg

SEQ ID NO: 436 - RNA, 20 nt, Artificial Sequence
  Description of Artificial Sequence: Synthetic oligonucleotide
ucacccugccagucuuuugu

SEQ ID NO: 437 - RNA, 20 nt, Artificial Sequence
  Description of Artificial Sequence: Synthetic oligonucleotide
aucacccugccagucuuuug

SEQ ID NO: 438 - RNA, 20 nt, Artificial Sequence
  Description of Artificial Sequence: Synthetic oligonucleotide
gcccacucauuaaguacauu

SEQ ID NO: 439 - RNA, 20 nt, Artificial Sequence
  Description of Artificial Sequence: Synthetic oligonucleotide
cuguagcccacucauuaagu

SEQ ID NO: 440 - RNA, 20 nt, Artificial Sequence
  Description of Artificial Sequence: Synthetic oligonucleotide
cgcuguagcccacucauuaa

SEQ ID NO: 441 - RNA, 20 nt, Artificial Sequence
  Description of Artificial Sequence: Synthetic oligonucleotide
acgcuguagcccacucauua

SEQ ID NO: 442 - RNA, 20 nt, Artificial Sequence
  Description of Artificial Sequence: Synthetic oligonucleotide
uacgcuguagcccacucauu

SEQ ID NO: 443 - RNA, 20 nt, Artificial Sequence
  Description of Artificial Sequence: Synthetic oligonucleotide
auacgcuguagcccacucau

SEQ ID NO: 444 - RNA, 20 nt, Artificial Sequence
  Description of Artificial Sequence: Synthetic oligonucleotide
gauacgcuguagcccacuca

SEQ ID NO: 445 - RNA, 20 nt, Artificial Sequence
  Description of Artificial Sequence: Synthetic oligonucleotide
ggauacgcuguagcccacuc

SEQ ID NO: 446 - RNA, 20 nt, Artificial Sequence
  Description of Artificial Sequence: Synthetic oligonucleotide
aggauacgcuguagcccacu

SEQ ID NO: 447 - RNA, 20 nt, Artificial Sequence
  Description of Artificial Sequence: Synthetic oligonucleotide
gaggauacgcuguagcccac

SEQ ID NO: 448 - RNA, 20 nt, Artificial Sequence
  Description of Artificial Sequence: Synthetic oligonucleotide
ugaggauacgcuguagccca

SEQ ID NO: 449 - RNA, 20 nt, Artificial Sequence
  Description of Artificial Sequence: Synthetic oligonucleotide
gugaggauacgcuguagccc

SEQ ID NO: 450 - RNA, 20 nt, Artificial Sequence
  Description of Artificial Sequence: Synthetic oligonucleotide
ugugaggauacgcuguagcc

SEQ ID NO: 451 - RNA, 20 nt, Artificial Sequence
  Description of Artificial Sequence: Synthetic oligonucleotide
cuguugugaggauacgcugu

SEQ ID NO: 452 - RNA, 20 nt, Artificial Sequence
  Description of Artificial Sequence: Synthetic oligonucleotide
ucuguugugaggauacgcug

SEQ ID NO: 453 - RNA, 20 nt, Artificial Sequence
  Description of Artificial Sequence: Synthetic oligonucleotide
gucuguugugaggauacgcu

SEQ ID NO: 454 - RNA, 20 nt, Artificial Sequence
  Description of Artificial Sequence: Synthetic oligonucleotide
ugucuguugugaggauacgc

SEQ ID NO: 455 - RNA, 20 nt, Artificial Sequence
  Description of Artificial Sequence: Synthetic oligonucleotide
acugucuguugugaggauac

SEQ ID NO: 456 - RNA, 20 nt, Artificial Sequence
  Description of Artificial Sequence: Synthetic oligonucleotide
cacugucuguugugaggaua

SEQ ID NO: 457 - RNA, 20 nt, Artificial Sequence
  Description of Artificial Sequence: Synthetic oligonucleotide
caacucucucucacugucug

SEQ ID NO: 458 - RNA, 20 nt, Artificial Sequence
  Description of Artificial Sequence: Synthetic oligonucleotide
aacaacucucucucacuguc

SEQ ID NO: 459 - RNA, 20 nt, Artificial Sequence
  Description of Artificial Sequence: Synthetic oligonucleotide
agaacaacucucucucacug

SEQ ID NO: 460 - RNA, 20 nt, Artificial Sequence
  Description of Artificial Sequence: Synthetic oligonucleotide
guagaacaacucucucucac

SEQ ID NO: 461 - RNA, 20 nt, Artificial Sequence
  Description of Artificial Sequence: Synthetic oligonucleotide
gguagaacaacucucucuca

SEQ ID NO: 462 - RNA, 20 nt, Artificial Sequence
  Description of Artificial Sequence: Synthetic oligonucleotide
cagguagaacaacucucucu

SEQ ID NO: 463 - RNA, 20 nt, Artificial Sequence
  Description of Artificial Sequence: Synthetic oligonucleotide
ccagguagaacaacucucuc

SEQ ID NO: 464 - RNA, 20 nt, Artificial Sequence
  Description of Artificial Sequence: Synthetic oligonucleotide
acccagguagaacaacucuc

SEQ ID NO: 465 - RNA, 20 nt, Artificial Sequence
  Description of Artificial Sequence: Synthetic oligonucleotide
uauacccagguagaacaacu

SEQ ID NO: 466 - RNA, 20 nt, Artificial Sequence
  Description of Artificial Sequence: Synthetic oligonucleotide
auauacccagguagaacaac

SEQ ID NO: 467 - RNA, 20 nt, Artificial Sequence
  Description of Artificial Sequence: Synthetic oligonucleotide
ggauauacccagguagaaca

SEQ ID NO: 468 - RNA, 20 nt, Artificial Sequence
  Description of Artificial Sequence: Synthetic oligonucleotide
guuuuggauauacccaggua

SEQ ID NO: 469 - RNA, 20 nt, Artificial Sequence
  Description of Artificial Sequence: Synthetic oligonucleotide
ccuuguuuuggauauaccca

SEQ ID NO: 470 - RNA, 20 nt, Artificial Sequence
  Description of Artificial Sequence: Synthetic oligonucleotide
cccuuguuuuggauauaccc

SEQ ID NO: 471 - RNA, 20 nt, Artificial Sequence
  Description of Artificial Sequence: Synthetic oligonucleotide
ccucguaaacuccauacccu

SEQ ID NO: 472 - RNA, 20 nt, Artificial Sequence
  Description of Artificial Sequence: Synthetic oligonucleotide
cccucguaaacuccauaccc

SEQ ID NO: 473 - RNA, 20 nt, Artificial Sequence
  Description of Artificial Sequence: Synthetic oligonucleotide
acccucguaaacuccauacc

SEQ ID NO: 474 - RNA, 20 nt, Artificial Sequence
  Description of Artificial Sequence: Synthetic oligonucleotide
aacccucguaaacuccauac

SEQ ID NO: 475 - RNA, 20 nt, Artificial Sequence
  Description of Artificial Sequence: Synthetic oligonucleotide
gaacccucguaaacuccaua

SEQ ID NO: 476 - RNA, 20 nt, Artificial Sequence
  Description of Artificial Sequence: Synthetic oligonucleotide
ugaacccucguaaacuccau

SEQ ID NO: 477 - RNA, 20 nt, Artificial Sequence
  Description of Artificial Sequence: Synthetic oligonucleotide
uugaacccucguaaacucca

SEQ ID NO: 478 - RNA, 20 nt, Artificial Sequence
  Description of Artificial Sequence: Synthetic oligonucleotide
cuugaacccucguaaacucc

SEQ ID NO: 479 - RNA, 20 nt, Artificial Sequence
  Description of Artificial Sequence: Synthetic oligonucleotide
ccuugaacccucguaaacuc

SEQ ID NO: 480 - RNA, 20 nt, Artificial Sequence
  Description of Artificial Sequence: Synthetic oligonucleotide
accuugaacccucguaaacu

SEQ ID NO: 481 - RNA, 20 nt, Artificial Sequence
  Description of Artificial Sequence: Synthetic oligonucleotide
uaccuugaacccucguaaac

SEQ ID NO: 482 - RNA, 20 nt, Artificial Sequence
  Description of Artificial Sequence: Synthetic oligonucleotide
auaccuugaacccucguaaa

SEQ ID NO: 483 - RNA, 20 nt, Artificial Sequence
  Description of Artificial Sequence: Synthetic oligonucleotide
aauaccuugaacccucguaa

SEQ ID NO: 484 - RNA, 20 nt, Artificial Sequence
  Description of Artificial Sequence: Synthetic oligonucleotide
aaauaccuugaacccucgua

SEQ ID NO: 485 - RNA, 20 nt, Artificial Sequence
  Description of Artificial Sequence: Synthetic oligonucleotide
caaauaccuugaacccucgu

SEQ ID NO: 486 - RNA, 20 nt, Artificial Sequence
  Description of Artificial Sequence: Synthetic oligonucleotide
ccaaauaccuugaacccucg

SEQ ID NO: 487 - RNA, 20 nt, Artificial Sequence
  Description of Artificial Sequence: Synthetic oligonucleotide
accaaauaccuugaacccuc

SEQ ID NO: 488 - RNA, 20 nt, Artificial Sequence
  Description of Artificial Sequence: Synthetic oligonucleotide
aaccaaauaccuugaacccu

SEQ ID NO: 489 - RNA, 20 nt, Artificial Sequence
  Description of Artificial Sequence: Synthetic oligonucleotide
gaaccaaauaccuugaaccc

SEQ ID NO: 490 - RNA, 20 nt, Artificial Sequence
  Description of Artificial Sequence: Synthetic oligonucleotide
ugaaccaaauaccuugaacc

SEQ ID NO: 491 - RNA, 20 nt, Artificial Sequence
  Description of Artificial Sequence: Synthetic oligonucleotide
cccugaaccaaauaccuuga

SEQ ID NO: 492 - RNA, 20 nt, Artificial Sequence
  Description of Artificial Sequence: Synthetic oligonucleotide
ggcccugaaccaaauaccuu

SEQ ID NO: 493 - RNA, 20 nt, Artificial Sequence
  Description of Artificial Sequence: Synthetic oligonucleotide
uggcccugaaccaaauaccu

SEQ ID NO: 494 - RNA, 20 nt, Artificial Sequence
  Description of Artificial Sequence: Synthetic oligonucleotide
uauucagguuguugcccaaa

SEQ ID NO: 495 - RNA, 20 nt, Artificial Sequence
  Description of Artificial Sequence: Synthetic oligonucleotide
gguauucagguuguugccca

SEQ ID NO: 496 - RNA, 20 nt, Artificial Sequence
  Description of Artificial Sequence: Synthetic oligonucleotide
agguauucagguuguugccc

SEQ ID NO: 497 - RNA, 20 nt, Artificial Sequence
  Description of Artificial Sequence: Synthetic oligonucleotide
aagguauucagguuguugcc

SEQ ID NO: 498 - RNA, 20 nt, Artificial Sequence
  Description of Artificial Sequence: Synthetic oligonucleotide
aaagguauucagguuguugc

SEQ ID NO: 499 - RNA, 20 nt, Artificial Sequence
  Description of Artificial Sequence: Synthetic oligonucleotide
uaacuugauugcccugugac

SEQ ID NO: 500 - RNA, 20 nt, Artificial Sequence
  Description of Artificial Sequence: Synthetic oligonucleotide
guaacuugauugcccuguga

SEQ ID NO: 501 - RNA, 20 nt, Artificial Sequence
  Description of Artificial Sequence: Synthetic oligonucleotide
aguaacuugauugcccugug

SEQ ID NO: 502 - RNA, 20 nt, Artificial Sequence
  Description of Artificial Sequence: Synthetic oligonucleotide
cagaguaacuugauugcccu

SEQ ID NO: 503 - RNA, 20 nt, Artificial Sequence
  Description of Artificial Sequence: Synthetic oligonucleotide
acagaguaacuugauugccc

SEQ ID NO: 504 - RNA, 20 nt, Artificial Sequence
  Description of Artificial Sequence: Synthetic oligonucleotide
cacagaguaacuugauugcc

SEQ ID NO: 505 - RNA, 20 nt, Artificial Sequence
  Description of Artificial Sequence: Synthetic oligonucleotide
uguccugacaaagaaacaca

SEQ ID NO: 506 - RNA, 20 nt, Artificial Sequence
  Description of Artificial Sequence: Synthetic oligonucleotide
caaucccugcuuuccugcca

SEQ ID NO: 507 - RNA, 20 nt, Artificial Sequence
  Description of Artificial Sequence: Synthetic oligonucleotide
acaaucccugcuuuccugcc

SEQ ID NO: 508 - RNA, 20 nt, Artificial Sequence
  Description of Artificial Sequence: Synthetic oligonucleotide
aacacaaucccugcuuuccu

SEQ ID NO: 509 - RNA, 20 nt, Artificial Sequence
  Description of Artificial Sequence: Synthetic oligonucleotide
gaacacaaucccugcuuucc

SEQ ID NO: 510 - RNA, 20 nt, Artificial Sequence
  Description of Artificial Sequence: Synthetic oligonucleotide
aaugaacacaaucccugcuu

SEQ ID NO: 511 - RNA, 20 nt, Artificial Sequence
  Description of Artificial Sequence: Synthetic oligonucleotide
aaaugaacacaaucccugcu

SEQ ID NO: 512 - RNA, 20 nt, Artificial Sequence
  Description of Artificial Sequence: Synthetic oligonucleotide
gugaaacccucaaaugaaca

SEQ ID NO: 513 - RNA, 20 nt, Artificial Sequence
  Description of Artificial Sequence: Synthetic oligonucleotide
agugaaacccucaaaugaac

SEQ ID NO: 514 - RNA, 20 nt, Artificial Sequence
  Description of Artificial Sequence: Synthetic oligonucleotide
cagugaaacccucaaaugaa

SEQ ID NO: 515 - RNA, 20 nt, Artificial Sequence
  Description of Artificial Sequence: Synthetic oligonucleotide
acagugaaacccucaaauga

SEQ ID NO: 516 - RNA, 20 nt, Artificial Sequence
  Description of Artificial Sequence: Synthetic oligonucleotide
gcauggaagcugagacucuc

SEQ ID NO: 517 - RNA, 20 nt, Artificial Sequence
  Description of Artificial Sequence: Synthetic oligonucleotide
uugcauggaagcugagacuc

SEQ ID NO: 518 - RNA, 20 nt, Artificial Sequence
  Description of Artificial Sequence: Synthetic oligonucleotide
caguugcauggaagcugaga

SEQ ID NO: 519 - RNA, 20 nt, Artificial Sequence
  Description of Artificial Sequence: Synthetic oligonucleotide
acaguugcauggaagcugag

SEQ ID NO: 520 - RNA, 20 nt, Artificial Sequence
  Description of Artificial Sequence: Synthetic oligonucleotide
gacaguugcauggaagcuga

SEQ ID NO: 521 - RNA, 20 nt, Artificial Sequence
  Description of Artificial Sequence: Synthetic oligonucleotide
auggacaguugcauggaagc

SEQ ID NO: 522 - RNA, 20 nt, Artificial Sequence
  Description of Artificial Sequence: Synthetic oligonucleotide
gugauggacaguugcaugga

SEQ ID NO: 523 - RNA, 20 nt, Artificial Sequence
  Description of Artificial Sequence: Synthetic oligonucleotide
cgugauggacaguugcaugg

SEQ ID NO: 524 - RNA, 20 nt, Artificial Sequence
  Description of Artificial Sequence: Synthetic oligonucleotide
ccgugauggacaguugcaug

SEQ ID NO: 525 - RNA, 20 nt, Artificial Sequence
  Description of Artificial Sequence: Synthetic oligonucleotide
gccgugauggacaguugcau

SEQ ID NO: 526 - RNA, 20 nt, Artificial Sequence
  Description of Artificial Sequence: Synthetic oligonucleotide
agccgugauggacaguugca

SEQ ID NO: 527 - RNA, 20 nt, Artificial Sequence
  Description of Artificial Sequence: Synthetic oligonucleotide
cagccgugauggacaguugc

SEQ ID NO: 528 - RNA, 20 nt, Artificial Sequence
  Description of Artificial Sequence: Synthetic oligonucleotide
gcagccgugauggacaguug

SEQ ID NO: 529 - RNA, 20 nt, Artificial Sequence
  Description of Artificial Sequence: Synthetic oligonucleotide
ugcagccgugauggacaguu

SEQ ID NO: 530 - RNA, 20 nt, Artificial Sequence
  Description of Artificial Sequence: Synthetic oligonucleotide
uugcagccgugauggacagu

SEQ ID NO: 531 - RNA, 20 nt, Artificial Sequence
  Description of Artificial Sequence: Synthetic oligonucleotide
guugcagccgugauggacag

SEQ ID NO: 532 - RNA, 20 nt, Artificial Sequence
  Description of Artificial Sequence: Synthetic oligonucleotide
caguugcagccgugauggac

SEQ ID NO: 533 - RNA, 20 nt, Artificial Sequence
  Description of Artificial Sequence: Synthetic oligonucleotide
ucaguugcagccgugaugga

SEQ ID NO: 534 - RNA, 20 nt, Artificial Sequence
  Description of Artificial Sequence: Synthetic oligonucleotide
uucaguugcagccgugaugg

SEQ ID NO: 535 - RNA, 20 nt, Artificial Sequence
  Description of Artificial Sequence: Synthetic oligonucleotide
uuucaguugcagccgugaug

SEQ ID NO: 536 - RNA, 20 nt, Artificial Sequence
  Description of Artificial Sequence: Synthetic oligonucleotide
auuucaguugcagccgugau

SEQ ID NO: 537 - RNA, 20 nt, Artificial Sequence
  Description of Artificial Sequence: Synthetic oligonucleotide
gauuucaguugcagccguga

SEQ ID NO: 538 - RNA, 20 nt, Artificial Sequence
  Description of Artificial Sequence: Synthetic oligonucleotide
ugauuucaguugcagccgug

SEQ ID NO: 539 - RNA, 20 nt, Artificial Sequence
  Description of Artificial Sequence: Synthetic oligonucleotide
cucugauuucaguugcagcc

SEQ ID NO: 540 - RNA, 20 nt, Artificial Sequence
  Description of Artificial Sequence: Synthetic oligonucleotide
uuagcuucuggugcgcugug

SEQ ID NO: 541 - RNA, 20 nt, Artificial Sequence
  Description of Artificial Sequence: Synthetic oligonucleotide
uuuagcuucuggugcgcugu

SEQ ID NO: 542 - RNA, 20 nt, Artificial Sequence
  Description of Artificial Sequence: Synthetic oligonucleotide
cuuuagcuucuggugcgcug

SEQ ID NO: 543 - RNA, 20 nt, Artificial Sequence
  Description of Artificial Sequence: Synthetic oligonucleotide
gacuuuagcuucuggugcgc

SEQ ID NO: 544 - RNA, 20 nt, Artificial Sequence
  Description of Artificial Sequence: Synthetic oligonucleotide
agacuuuagcuucuggugcg

SEQ ID NO: 545 - RNA, 20 nt, Artificial Sequence
  Description of Artificial Sequence: Synthetic oligonucleotide
aagacuuuagcuucuggugc

SEQ ID NO: 546 - RNA, 20 nt, Artificial Sequence
  Description of Artificial Sequence: Synthetic oligonucleotide
ucaagacuuuagcuucuggu

SEQ ID NO: 547 - RNA, 20 nt, Artificial Sequence
  Description of Artificial Sequence: Synthetic oligonucleotide
aucaagacuuuagcuucugg

SEQ ID NO: 548 - RNA, 20 nt, Artificial Sequence
  Description of Artificial Sequence: Synthetic oligonucleotide
gcaucaagacuuuagcuucu

SEQ ID NO: 549 - RNA, 20 nt, Artificial Sequence
  Description of Artificial Sequence: Synthetic oligonucleotide
auggcaucaagacuuuagcu

SEQ ID NO: 550 - RNA, 20 nt, Artificial Sequence
  Description of Artificial Sequence: Synthetic oligonucleotide
gauggcaucaagacuuuagc

SEQ ID NO: 551 - RNA, 20 nt, Artificial Sequence
  Description of Artificial Sequence: Synthetic oligonucleotide
agggauguccuuugauggca

SEQ ID NO: 552 - RNA, 20 nt, Artificial Sequence
  Description of Artificial Sequence: Synthetic oligonucleotide
gcagggauguccuuugaugg

SEQ ID NO: 553 - RNA, 20 nt, Artificial Sequence
  Description of Artificial Sequence: Synthetic oligonucleotide
ggcagggauguccuuugaug

SEQ ID NO: 554 - RNA, 20 nt, Artificial Sequence
  Description of Artificial Sequence: Synthetic oligonucleotide
cgugacagagaugugaaugg

SEQ ID NO: 555 - RNA, 20 nt, Artificial Sequence
  Description of Artificial Sequence: Synthetic oligonucleotide
ggacgugacagagaugugaa

SEQ ID NO: 556 - RNA, 20 nt, Artificial Sequence
  Description of Artificial Sequence: Synthetic oligonucleotide
uggacgugacagagauguga

SEQ ID NO: 557 - RNA, 20 nt, Artificial Sequence
  Description of Artificial Sequence: Synthetic oligonucleotide
guggacgugacagagaugug

SEQ ID NO: 558 - RNA, 20 nt, Artificial Sequence
  Description of Artificial Sequence: Synthetic oligonucleotide
aguggacgugacagagaugu

SEQ ID NO: 559 - RNA, 20 nt, Artificial Sequence
  Description of Artificial Sequence: Synthetic oligonucleotide
uaguggacgugacagagaug

SEQ ID NO: 560 - RNA, 20 nt, Artificial Sequence
  Description of Artificial Sequence: Synthetic oligonucleotide
uuaguggacgugacagagau

SEQ ID NO: 561 - RNA, 20 nt, Artificial Sequence
  Description of Artificial Sequence: Synthetic oligonucleotide
auuaguggacgugacagaga

SEQ ID NO: 562 - RNA, 20 nt, Artificial Sequence
  Description of Artificial Sequence: Synthetic oligonucleotide
gauuaguggacgugacagag

SEQ ID NO: 563 - RNA, 20 nt, Artificial Sequence
  Description of Artificial Sequence: Synthetic oligonucleotide
cgauuaguggacgugacaga

SEQ ID NO: 564 - RNA, 20 nt, Artificial Sequence
  Description of Artificial Sequence: Synthetic oligonucleotide
ccgauuaguggacgugacag

SEQ ID NO: 565 - RNA, 20 nt, Artificial Sequence
  Description of Artificial Sequence: Synthetic oligonucleotide
ugccgauuaguggacgugac

SEQ ID NO: 566 - RNA, 20 nt, Artificial Sequence
  Description of Artificial Sequence: Synthetic oligonucleotide
uugccgauuaguggacguga

SEQ ID NO: 567 - RNA, 20 nt, Artificial Sequence
  Description of Artificial Sequence: Synthetic oligonucleotide
uuugccgauuaguggacgug

SEQ ID NO: 568 - RNA, 20 nt, Artificial Sequence
  Description of Artificial Sequence: Synthetic oligonucleotide
uuuugccgauuaguggacgu

SEQ ID NO: 569 - RNA, 20 nt, Artificial Sequence
  Description of Artificial Sequence: Synthetic oligonucleotide
cuuuugccgauuaguggacg

SEQ ID NO: 570 - RNA, 20 nt, Artificial Sequence
  Description of Artificial Sequence: Synthetic oligonucleotide
ccuuuugccgauuaguggac

SEQ ID NO: 571 - RNA, 20 nt, Artificial Sequence
  Description of Artificial Sequence: Synthetic oligonucleotide
uccuuuugccgauuagugga

SEQ ID NO: 572 - RNA, 20 nt, Artificial Sequence
  Description of Artificial Sequence: Synthetic oligonucleotide
cuccuuuugccgauuagugg

SEQ ID NO: 573 - RNA, 20 nt, Artificial Sequence
  Description of Artificial Sequence: Synthetic oligonucleotide
ucuccuuuugccgauuagug

SEQ ID NO: 574 - RNA, 20 nt, Artificial Sequence
  Description of Artificial Sequence: Synthetic oligonucleotide
uucuccuuuugccgauuagu

SEQ ID NO: 575 - RNA, 20 nt, Artificial Sequence
  Description of Artificial Sequence: Synthetic oligonucleotide
uuucuccuuuugccgauuag

SEQ ID NO: 576 - RNA, 20 nt, Artificial Sequence
  Description of Artificial Sequence: Synthetic oligonucleotide
aggucaucuucucucacuuu

SEQ ID NO: 577 - RNA, 20 nt, Artificial Sequence
  Description of Artificial Sequence: Synthetic oligonucleotide
uuaggucaucuucucucacu

SEQ ID NO: 578 - RNA, 20 nt, Artificial Sequence
  Description of Artificial Sequence: Synthetic oligonucleotide
cuuaggucaucuucucucac

SEQ ID NO: 579 - RNA, 20 nt, Artificial Sequence
  Description of Artificial Sequence: Synthetic oligonucleotide
acacuuaggucaucuucucu

SEQ ID NO: 580 - RNA, 20 nt, Artificial Sequence
  Description of Artificial Sequence: Synthetic oligonucleotide
cacacuuaggucaucuucuc

SEQ ID NO: 581 - RNA, 20 nt, Artificial Sequence
  Description of Artificial Sequence: Synthetic oligonucleotide
ucacacuuaggucaucuucu

SEQ ID NO: 582 - RNA, 20 nt, Artificial Sequence
  Description of Artificial Sequence: Synthetic oligonucleotide
gucacacuuaggucaucuuc

SEQ ID NO: 583 - RNA, 20 nt, Artificial Sequence
  Description of Artificial Sequence: Synthetic oligonucleotide
agucacacuuaggucaucuu

SEQ ID NO: 584 - RNA, 20 nt, Artificial Sequence
  Description of Artificial Sequence: Synthetic oligonucleotide
cagucacacuuaggucaucu

SEQ ID NO: 585 - RNA, 20 nt, Artificial Sequence
  Description of Artificial Sequence: Synthetic oligonucleotide
gcagucacacuuaggucauc

SEQ ID NO: 586 - RNA, 20 nt, Artificial Sequence
  Description of Artificial Sequence: Synthetic oligonucleotide
ugcagucacacuuaggucau

SEQ ID NO: 587 - RNA, 20 nt, Artificial Sequence
  Description of Artificial Sequence: Synthetic oligonucleotide
auuuuccagagcugccugcu

SEQ ID NO: 588 - RNA, 20 nt, Artificial Sequence
  Description of Artificial Sequence: Synthetic oligonucleotide
cucacugcucuggcuucauu

SEQ ID NO: 589 - RNA, 20 nt, Artificial Sequence
  Description of Artificial Sequence: Synthetic oligonucleotide
gcucacugcucuggcuucau

SEQ ID NO: 590 - RNA, 20 nt, Artificial Sequence
  Description of Artificial Sequence: Synthetic oligonucleotide
uuaccugcucuuuccuuccu

SEQ ID NO: 591 - RNA, 20 nt, Artificial Sequence
  Description of Artificial Sequence: Synthetic oligonucleotide
ugcuuaccugcucuuuccuu

SEQ ID NO: 592 - RNA, 20 nt, Artificial Sequence
  Description of Artificial Sequence: Synthetic oligonucleotide
uuccugcuuaccugcucuuu

SEQ ID NO: 593 - RNA, 20 nt, Artificial Sequence
  Description of Artificial Sequence: Synthetic oligonucleotide
cuuccugcuuaccugcucuu

SEQ ID NO: 594 - RNA, 20 nt, Artificial Sequence
  Description of Artificial Sequence: Synthetic oligonucleotide
acuggccuuccugcuuaccu

SEQ ID NO: 595 - RNA, 20 nt, Artificial Sequence
  Description of Artificial Sequence: Synthetic oligonucleotide
gacacuggccuuccugcuua

SEQ ID NO: 596 - RNA, 20 nt, Artificial Sequence
  Description of Artificial Sequence: Synthetic oligonucleotide
cauuaggguccugucuggga

SEQ ID NO: 597 - RNA, 20 nt, Artificial Sequence
  Description of Artificial Sequence: Synthetic oligonucleotide
ucauuaggguccugucuggg

SEQ ID NO: 598 - RNA, 20 nt, Artificial Sequence
  Description of Artificial Sequence: Synthetic oligonucleotide
aucauuaggguccugucugg

SEQ ID NO: 599 - RNA, 20 nt, Artificial Sequence
  Description of Artificial Sequence: Synthetic oligonucleotide
gaucauuaggguccugucug

SEQ ID NO: 600 - RNA, 20 nt, Artificial Sequence
  Description of Artificial Sequence: Synthetic oligonucleotide
ggaucauuaggguccugucu

SEQ ID NO: 601 - RNA, 20 nt, Artificial Sequence
  Description of Artificial Sequence: Synthetic oligonucleotide
auucaggaucauuagggucc

SEQ ID NO: 602 - RNA, 20 nt, Artificial Sequence
  Description of Artificial Sequence: Synthetic oligonucleotide
gauucaggaucauuaggguc

SEQ ID NO: 603 - RNA, 20 nt, Artificial Sequence
  Description of Artificial Sequence: Synthetic oligonucleotide
ggauucaggaucauuagggu

SEQ ID NO: 604 - RNA, 20 nt, Artificial Sequence
  Description of Artificial Sequence: Synthetic oligonucleotide
auggauucaggaucauuagg

SEQ ID NO: 605 - RNA, 20 nt, Artificial Sequence
  Description of Artificial Sequence: Synthetic oligonucleotide
gauacauggauucaggauca

SEQ ID NO: 606 - RNA, 20 nt, Artificial Sequence
  Description of Artificial Sequence: Synthetic oligonucleotide
ugauacauggauucaggauc

SEQ ID NO: 607 - RNA, 20 nt, Artificial Sequence
  Description of Artificial Sequence: Synthetic oligonucleotide
auggcagggcuuuggaaaau

SEQ ID NO: 608 - RNA, 20 nt, Artificial Sequence
  Description of Artificial Sequence: Synthetic oligonucleotide
cauggcagggcuuuggaaaa

SEQ ID NO: 609 - RNA, 20 nt, Artificial Sequence
  Description of Artificial Sequence: Synthetic oligonucleotide
gcauggcagggcuuuggaaa

SEQ ID NO: 610 - RNA, 20 nt, Artificial Sequence
  Description of Artificial Sequence: Synthetic oligonucleotide
cagcauggcagggcuuugga

SEQ ID NO: 611 - RNA, 20 nt, Artificial Sequence
  Description of Artificial Sequence: Synthetic oligonucleotide
gaagugggauggcagcaugg

SEQ ID NO: 612 - RNA, 20 nt, Artificial Sequence
  Description of Artificial Sequence: Synthetic oligonucleotide
ggaagugggauggcagcaug

SEQ ID NO: 613 - RNA, 20 nt, Artificial Sequence
  Description of Artificial Sequence: Synthetic oligonucleotide
gggaagugggauggcagcau

SEQ ID NO: 614 - RNA, 20 nt, Artificial Sequence
  Description of Artificial Sequence: Synthetic oligonucleotide
uggagaagccauaagcugca

SEQ ID NO: 615 - RNA, 20 nt, Artificial Sequence
  Description of Artificial Sequence: Synthetic oligonucleotide
cuggagaagccauaagcugc

SEQ ID NO: 616 - RNA, 20 nt, Artificial Sequence
  Description of Artificial Sequence: Synthetic oligonucleotide
acuggagaagccauaagcug

SEQ ID NO: 617 - RNA, 20 nt, Artificial Sequence
  Description of Artificial Sequence: Synthetic oligonucleotide
uacuggagaagccauaagcu

SEQ ID NO: 618 - RNA, 20 nt, Artificial Sequence
  Description of Artificial Sequence: Synthetic oligonucleotide
cuacuggagaagccauaagc

SEQ ID NO: 619 - RNA, 20 nt, Artificial Sequence
  Description of Artificial Sequence: Synthetic oligonucleotide
ccuacuggagaagccauaag

SEQ ID NO: 620 - RNA, 20 nt, Artificial Sequence
  Description of Artificial Sequence: Synthetic oligonucleotide
accuacuggagaagccauaa

SEQ ID NO: 621 - RNA, 20 nt, Artificial Sequence
  Description of Artificial Sequence: Synthetic oligonucleotide
caccuacuggagaagccaua

SEQ ID NO: 622 - RNA, 20 nt, Artificial Sequence
  Description of Artificial Sequence: Synthetic oligonucleotide
ccaccuacuggagaagccau

SEQ ID NO: 623 - RNA, 20 nt, Artificial Sequence
  Description of Artificial Sequence: Synthetic oligonucleotide
gccaccuacuggagaagcca

SEQ ID NO: 624 - RNA, 20 nt, Artificial Sequence
  Description of Artificial Sequence: Synthetic oligonucleotide
cugccaccuacuggagaagc

SEQ ID NO: 625 - RNA, 20 nt, Artificial Sequence
  Description of Artificial Sequence: Synthetic oligonucleotide
gcugccaccuacuggagaag

SEQ ID NO: 626 - RNA, 20 nt, Artificial Sequence
  Description of Artificial Sequence: Synthetic oligonucleotide
ugugugugcugccaccuacu

SEQ ID NO: 627 - RNA, 20 nt, Artificial Sequence
  Description of Artificial Sequence: Synthetic oligonucleotide
cugugugugcugccaccuac

SEQ ID NO: 628 - RNA, 20 nt, Artificial Sequence
  Description of Artificial Sequence: Synthetic oligonucleotide
uuaugaguggcucugugugu

SEQ ID NO: 629 - RNA, 20 nt, Artificial Sequence
  Description of Artificial Sequence: Synthetic oligonucleotide
uuuaugaguggcucugugug

SEQ ID NO: 630 - RNA, 20 nt, Artificial Sequence
  Description of Artificial Sequence: Synthetic oligonucleotide
aguuuaugaguggcucugug

SEQ ID NO: 631 - RNA, 20 nt, Artificial Sequence
  Description of Artificial Sequence: Synthetic oligonucleotide
caguuuaugaguggcucugu

SEQ ID NO: 632 - RNA, 20 nt, Artificial Sequence
  Description of Artificial Sequence: Synthetic oligonucleotide
guuucuggcucucaggcucu

SEQ ID NO: 633 - RNA, 20 nt, Artificial Sequence
  Description of Artificial Sequence: Synthetic oligonucleotide
gguuucuggcucucaggcuc

SEQ ID NO: 634 - RNA, 20 nt, Artificial Sequence
  Description of Artificial Sequence: Synthetic oligonucleotide
cgguuucuggcucucaggcu

SEQ ID NO: 635 - RNA, 20 nt, Artificial Sequence
  Description of Artificial Sequence: Synthetic oligonucleotide
ggacgguuucuggcucucag

SEQ ID NO: 636 - RNA, 20 nt, Artificial Sequence
  Description of Artificial Sequence: Synthetic oligonucleotide
gggacgguuucuggcucuca

SEQ ID NO: 637 - RNA, 20 nt, Artificial Sequence
  Description of Artificial Sequence: Synthetic oligonucleotide
ugaaaugugacuucuggugu

SEQ ID NO: 638 - RNA, 20 nt, Artificial Sequence
  Description of Artificial Sequence: Synthetic oligonucleotide
gggaaccauguaaaaggaug

SEQ ID NO: 639 - RNA, 20 nt, Artificial Sequence
  Description of Artificial Sequence: Synthetic oligonucleotide
gugaggguagaugggaacca

SEQ ID NO: 640 - RNA, 20 nt, Artificial Sequence
  Description of Artificial Sequence: Synthetic oligonucleotide
uugugaggguagaugggaac

SEQ ID NO: 641 - RNA, 20 nt, Artificial Sequence
  Description of Artificial Sequence: Synthetic oligonucleotide
guugugaggguagaugggaa

SEQ ID NO: 642 - RNA, 20 nt, Artificial Sequence
  Description of Artificial Sequence: Synthetic oligonucleotide
uguugugaggguagauggga

SEQ ID NO: 643 - RNA, 20 nt, Artificial Sequence
  Description of Artificial Sequence: Synthetic oligonucleotide
augugugucuuuggugauga

SEQ ID NO: 644 - RNA, 20 nt, Artificial Sequence
  Description of Artificial Sequence: Synthetic oligonucleotide
ggagcuuguaugugugucuu

SEQ ID NO: 645 - RNA, 20 nt, Artificial Sequence
  Description of Artificial Sequence: Synthetic oligonucleotide
uuggagcuuguauguguguc

SEQ ID NO: 646 - RNA, 20 nt, Artificial Sequence
  Description of Artificial Sequence: Synthetic oligonucleotide
auuggagcuuguaugugugu

SEQ ID NO: 647 - RNA, 20 nt, Artificial Sequence
  Description of Artificial Sequence: Synthetic oligonucleotide
cauuggagcuuguaugugug

SEQ ID NO: 648 - RNA, 20 nt, Artificial Sequence
  Description of Artificial Sequence: Synthetic oligonucleotide
ccauuggagcuuguaugugu

SEQ ID NO: 649 - RNA, 20 nt, Artificial Sequence
  Description of Artificial Sequence: Synthetic oligonucleotide
gccauuggagcuuguaugug

SEQ ID NO: 650 - RNA, 20 nt, Artificial Sequence
  Description of Artificial Sequence: Synthetic oligonucleotide
agccauuggagcuuguaugu

SEQ ID NO: 651 - RNA, 20 nt, Artificial Sequence
  Description of Artificial Sequence: Synthetic oligonucleotide
cuggaggaagaauugccugg

SEQ ID NO: 652 - RNA, 20 nt, Artificial Sequence
  Description of Artificial Sequence: Synthetic oligonucleotide
guccuggaggaagaauugcc

SEQ ID NO: 653 - RNA, 20 nt, Artificial Sequence
  Description of Artificial Sequence: Synthetic oligonucleotide
gccaguaagaagggcaaagu

SEQ ID NO: 654 - RNA, 20 nt, Artificial Sequence
  Description of Artificial Sequence: Synthetic oligonucleotide
ggccaguaagaagggcaaag

SEQ ID NO: 655 - RNA, 20 nt, Artificial Sequence
  Description of Artificial Sequence: Synthetic oligonucleotide
ggaaugagucaagccuggac

SEQ ID NO: 656 - RNA, 20 nt, Artificial Sequence
  Description of Artificial Sequence: Synthetic oligonucleotide
gggaaugagucaagccugga

SEQ ID NO: 657 - RNA, 20 nt, Artificial Sequence
  Description of Artificial Sequence: Synthetic oligonucleotide
gugggaaugagucaagccug

SEQ ID NO: 658 - RNA, 20 nt, Artificial Sequence
  Description of Artificial Sequence: Synthetic oligonucleotide
aaggugggaaugagucaagc

SEQ ID NO: 659 - RNA, 20 nt, Artificial Sequence
  Description of Artificial Sequence: Synthetic oligonucleotide
ucucagcccaggacaaggug

SEQ ID NO: 660 - RNA, 20 nt, Artificial Sequence
  Description of Artificial Sequence: Synthetic oligonucleotide
aucucagcccaggacaaggu

SEQ ID NO: 661 - RNA, 20 nt, Artificial Sequence
  Description of Artificial Sequence: Synthetic oligonucleotide
gcugggugguucucuccugu

SEQ ID NO: 662 - RNA, 20 nt, Artificial Sequence
  Description of Artificial Sequence: Synthetic oligonucleotide
uucugggcugggugguucuc

SEQ ID NO: 663 - RNA, 20 nt, Artificial Sequence
  Description of Artificial Sequence: Synthetic oligonucleotide
gaacuucugggcuggguggu

SEQ ID NO: 664 - RNA, 20 nt, Artificial Sequence
  Description of Artificial Sequence: Synthetic oligonucleotide
cggagaguuccuucccugga

SEQ ID NO: 665 - RNA, 20 nt, Artificial Sequence
  Description of Artificial Sequence: Synthetic oligonucleotide
accggagaguuccuucccug

SEQ ID NO: 666 - RNA, 20 nt, Artificial Sequence
  Description of Artificial Sequence: Synthetic oligonucleotide
gaccggagaguuccuucccu

SEQ ID NO: 667 - RNA, 20 nt, Artificial Sequence
  Description of Artificial Sequence: Synthetic oligonucleotide
uggaccggagaguuccuucc

SEQ ID NO: 668 - RNA, 20 nt, Artificial Sequence
  Description of Artificial Sequence: Synthetic oligonucleotide
guggaccggagaguuccuuc

SEQ ID NO: 669 - RNA, 20 nt, Artificial Sequence
  Description of Artificial Sequence: Synthetic oligonucleotide
gguggaccggagaguuccuu

SEQ ID NO: 670 - RNA, 20 nt, Artificial Sequence
  Description of Artificial Sequence: Synthetic oligonucleotide
ugguggaccggagaguuccu

SEQ ID NO: 671 - RNA, 20 nt, Artificial Sequence
  Description of Artificial Sequence: Synthetic oligonucleotide
augguggaccggagaguucc

SEQ ID NO: 672 - RNA, 20 nt, Artificial Sequence
  Description of Artificial Sequence: Synthetic oligonucleotide
caugguggaccggagaguuc

SEQ ID NO: 673 - RNA, 20 nt, Artificial Sequence
  Description of Artificial Sequence: Synthetic oligonucleotide
gagcugagagguacuccaug

SEQ ID NO: 674 - RNA, 20 nt, Artificial Sequence
  Description of Artificial Sequence: Synthetic oligonucleotide
agagcugagagguacuccau

SEQ ID NO: 675 - RNA, 20 nt, Artificial Sequence
  Description of Artificial Sequence: Synthetic oligonucleotide
cagagcugagagguacucca

SEQ ID NO: 676 - RNA, 20 nt, Artificial Sequence
  Description of Artificial Sequence: Synthetic oligonucleotide
uucagagcugagagguacuc

SEQ ID NO: 677 - RNA, 20 nt, Artificial Sequence
  Description of Artificial Sequence: Synthetic oligonucleotide
gguucagagcugagagguac

SEQ ID NO: 678 - RNA, 20 nt, Artificial Sequence
  Description of Artificial Sequence: Synthetic oligonucleotide
ggguucagagcugagaggua

SEQ ID NO: 679 - RNA, 20 nt, Artificial Sequence
  Description of Artificial Sequence: Synthetic oligonucleotide
caccugaguaagucacuggg

SEQ ID NO: 680 - RNA, 20 nt, Artificial Sequence
  Description of Artificial Sequence: Synthetic oligonucleotide
ucaccugaguaagucacugg

SEQ ID NO: 681 - RNA, 20 nt, Artificial Sequence
  Description of Artificial Sequence: Synthetic oligonucleotide
gucaccugaguaagucacug

SEQ ID NO: 682 - RNA, 20 nt, Artificial Sequence
  Description of Artificial Sequence: Synthetic oligonucleotide
agucaccugaguaagucacu

SEQ ID NO: 683 - RNA, 20 nt, Artificial Sequence
  Description of Artificial Sequence: Synthetic oligonucleotide
cagucaccugaguaagucac

SEQ ID NO: 684 - RNA, 20 nt, Artificial Sequence
  Description of Artificial Sequence: Synthetic oligonucleotide
gcagucaccugaguaaguca

SEQ ID NO: 685 - RNA, 20 nt, Artificial Sequence
  Description of Artificial Sequence: Synthetic oligonucleotide
uuagcagucaccugaguaag

SEQ ID NO: 686 - RNA, 20 nt, Artificial Sequence
  Description of Artificial Sequence: Synthetic oligonucleotide
guuagcagucaccugaguaa

SEQ ID NO: 687 - RNA, 20 nt, Artificial Sequence
  Description of Artificial Sequence: Synthetic oligonucleotide
gguuagcagucaccugagua

SEQ ID NO: 688 - RNA, 20 nt, Artificial Sequence
  Description of Artificial Sequence: Synthetic oligonucleotide
ggguuagcagucaccugagu

SEQ ID NO: 689 - RNA, 20 nt, Artificial Sequence
  Description of Artificial Sequence: Synthetic oligonucleotide
aggguuagcagucaccugag

SEQ ID NO: 690 - RNA, 20 nt, Artificial Sequence
  Description of Artificial Sequence: Synthetic oligonucleotide
gaggguuagcagucaccuga

SEQ ID NO: 691 - RNA, 20 nt, Artificial Sequence
  Description of Artificial Sequence: Synthetic oligonucleotide
ggaggguuagcagucaccug

SEQ ID NO: 692 - RNA, 20 nt, Artificial Sequence
  Description of Artificial Sequence: Synthetic oligonucleotide
cggaggguuagcagucaccu

SEQ ID NO: 693 - RNA, 20 nt, Artificial Sequence
  Description of Artificial Sequence: Synthetic oligonucleotide
agcggaggguuagcagucac

SEQ ID NO: 694 - RNA, 20 nt, Artificial Sequence
  Description of Artificial Sequence: Synthetic oligonucleotide
gagcggaggguuagcaguca

SEQ ID NO: 695 - RNA, 20 nt, Artificial Sequence
  Description of Artificial Sequence: Synthetic oligonucleotide
agagcggaggguuagcaguc

SEQ ID NO: 696 - RNA, 20 nt, Artificial Sequence
  Description of Artificial Sequence: Synthetic oligonucleotide
uagagcggaggguuagcagu

SEQ ID NO: 697 - RNA, 20 nt, Artificial Sequence
  Description of Artificial Sequence: Synthetic oligonucleotide
guagagcggaggguuagcag

SEQ ID NO: 698 - RNA, 20 nt, Artificial Sequence
  Description of Artificial Sequence: Synthetic oligonucleotide
gguagagcggaggguuagca

SEQ ID NO: 699 - RNA, 20 nt, Artificial Sequence
  Description of Artificial Sequence: Synthetic oligonucleotide
aggguagagcggaggguuag

SEQ ID NO: 700 - RNA, 20 nt, Artificial Sequence
  Description of Artificial Sequence: Synthetic oligonucleotide
gaggguagagcggaggguua

SEQ ID NO: 701 - RNA, 20 nt, Artificial Sequence
  Description of Artificial Sequence: Synthetic oligonucleotide
auuguugcccugccuauauc

SEQ ID NO: 702 - RNA, 20 nt, Artificial Sequence
  Description of Artificial Sequence: Synthetic oligonucleotide
aguauuguugcccugccuau

SEQ ID NO: 703 - RNA, 20 nt, Artificial Sequence
  Description of Artificial Sequence: Synthetic oligonucleotide
gaguauuguugcccugccua

SEQ ID NO: 704 - RNA, 20 nt, Artificial Sequence
  Description of Artificial Sequence: Synthetic oligonucleotide
ggaguauuguugcccugccu

SEQ ID NO: 705 - RNA, 20 nt, Artificial Sequence
  Description of Artificial Sequence: Synthetic oligonucleotide
uggaguauuguugcccugcc

SEQ ID NO: 706 - RNA, 20 nt, Artificial Sequence
  Description of Artificial Sequence: Synthetic oligonucleotide
guggaguauuguugcccugc

SEQ ID NO: 707 - RNA, 20 nt, Artificial Sequence
  Description of Artificial Sequence: Synthetic oligonucleotide
aguggaguauuguugcccug

SEQ ID NO: 708 - RNA, 20 nt, Artificial Sequence
  Description of Artificial Sequence: Synthetic oligonucleotide
gaguggaguauuguugcccu

SEQ ID NO: 709 - RNA, 20 nt, Artificial Sequence
  Description of Artificial Sequence: Synthetic oligonucleotide
ugaguggaguauuguugccc

SEQ ID NO: 710 - RNA, 20 nt, Artificial Sequence
  Description of Artificial Sequence: Synthetic oligonucleotide
cugaguggaguauuguugcc

SEQ ID NO: 711 - RNA, 20 nt, Artificial Sequence
  Description of Artificial Sequence: Synthetic oligonucleotide
gcugaguggaguauuguugc

SEQ ID NO: 712 - RNA, 20 nt, Artificial Sequence
  Description of Artificial Sequence: Synthetic oligonucleotide
ggcugaguggaguauuguug

SEQ ID NO: 713 - RNA, 20 nt, Artificial Sequence
  Description of Artificial Sequence: Synthetic oligonucleotide
gggcugaguggaguauuguu

SEQ ID NO: 714 - RNA, 20 nt, Artificial Sequence
  Description of Artificial Sequence: Synthetic oligonucleotide
gguacugguuagucuccuag

SEQ ID NO: 715 - RNA, 20 nt, Artificial Sequence
  Description of Artificial Sequence: Synthetic oligonucleotide
ggguacugguuagucuccua

SEQ ID NO: 716 - RNA, 20 nt, Artificial Sequence
  Description of Artificial Sequence: Synthetic oligonucleotide
uugacaagcccacuguggag

SEQ ID NO: 717 - RNA, 20 nt, Artificial Sequence
  Description of Artificial Sequence: Synthetic oligonucleotide
uggcucaggagcuugacaag

SEQ ID NO: 718 - RNA, 20 nt, Artificial Sequence
  Description of Artificial Sequence: Synthetic oligonucleotide
gguggcucaggagcuugaca

SEQ ID NO: 719 - RNA, 20 nt, Artificial Sequence
  Description of Artificial Sequence: Synthetic oligonucleotide
uagggaugagggagagacca

SEQ ID NO: 720 - RNA, 20 nt, Artificial Sequence
  Description of Artificial Sequence: Synthetic oligonucleotide
ucgauuagggaugagggaga

SEQ ID NO: 721 - RNA, 20 nt, Artificial Sequence
  Description of Artificial Sequence: Synthetic oligonucleotide
uagagggcuagggagggaga

SEQ ID NO: 722 - RNA, 20 nt, Artificial Sequence
  Description of Artificial Sequence: Synthetic oligonucleotide
guagaguggcuagagggcua

SEQ ID NO: 723 - RNA, 20 nt, Artificial Sequence
  Description of Artificial Sequence: Synthetic oligonucleotide
gguagaguggcuagagggcu

SEQ ID NO: 724 - RNA, 20 nt, Artificial Sequence
  Description of Artificial Sequence: Synthetic oligonucleotide
ugaggguagaguggcuagag

SEQ ID NO: 725 - RNA, 20 nt, Artificial Sequence
  Description of Artificial Sequence: Synthetic oligonucleotide
gaugaggguagaguggcuag

SEQ ID NO: 726 - RNA, 20 nt, Artificial Sequence
  Description of Artificial Sequence: Synthetic oligonucleotide
caugaugaggguagaguggc

SEQ ID NO: 727 - RNA, 20 nt, Artificial Sequence
  Description of Artificial Sequence: Synthetic oligonucleotide
gcaugaugaggguagagugg

SEQ ID NO: 728 - RNA, 20 nt, Artificial Sequence
  Description of Artificial Sequence: Synthetic oligonucleotide
gggcaugaugaggguagagu

SEQ ID NO: 729 - RNA, 20 nt, Artificial Sequence
  Description of Artificial Sequence: Synthetic oligonucleotide
gguaguugagaagaaaaguc

SEQ ID NO: 730 - RNA, 20 nt, Artificial Sequence
  Description of Artificial Sequence: Synthetic oligonucleotide
ccaaacuccgagcuuauauu

SEQ ID NO: 731 - RNA, 20 nt, Artificial Sequence
  Description of Artificial Sequence: Synthetic oligonucleotide
uccaaacuccgagcuuauau

SEQ ID NO: 732 - RNA, 20 nt, Artificial Sequence
  Description of Artificial Sequence: Synthetic oligonucleotide
guccaaacuccgagcuuaua

SEQ ID NO: 733 - RNA, 20 nt, Artificial Sequence
  Description of Artificial Sequence: Synthetic oligonucleotide
cguccaaacuccgagcuuau

SEQ ID NO: 734 - RNA, 20 nt, Artificial Sequence
  Description of Artificial Sequence: Synthetic oligonucleotide
ccguccaaacuccgagcuua

SEQ ID NO: 735 - RNA, 20 nt, Artificial Sequence
  Description of Artificial Sequence: Synthetic oligonucleotide
uccguccaaacuccgagcuu

SEQ ID NO: 736 - RNA, 20 nt, Artificial Sequence
  Description of Artificial Sequence: Synthetic oligonucleotide
cuccguccaaacuccgagcu

SEQ ID NO: 737 - RNA, 20 nt, Artificial Sequence
  Description of Artificial Sequence: Synthetic oligonucleotide
acccuccguccaaacuccga

SEQ ID NO: 738 - RNA, 20 nt, Artificial Sequence
  Description of Artificial Sequence: Synthetic oligonucleotide
agacccuccguccaaacucc

SEQ ID NO: 739 - RNA, 20 nt, Artificial Sequence
  Description of Artificial Sequence: Synthetic oligonucleotide
cagacccuccguccaaacuc

SEQ ID NO: 740 - RNA, 20 nt, Artificial Sequence
  Description of Artificial Sequence: Synthetic oligonucleotide
uccagacccuccguccaaac

SEQ ID NO: 741 - RNA, 20 nt, Artificial Sequence
  Description of Artificial Sequence: Synthetic oligonucleotide
guccagacccuccguccaaa

SEQ ID NO: 742 - RNA, 20 nt, Artificial Sequence
  Description of Artificial Sequence: Synthetic oligonucleotide
agacacggaaaggucgcugg

SEQ ID NO: 743 - RNA, 20 nt, Artificial Sequence
  Description of Artificial Sequence: Synthetic oligonucleotide
cagacacggaaaggucgcug

SEQ ID NO: 744 - RNA, 20 nt, Artificial Sequence
  Description of Artificial Sequence: Synthetic oligonucleotide
acagacacggaaaggucgcu

SEQ ID NO: 745 - RNA, 20 nt, Artificial Sequence
  Description of Artificial Sequence: Synthetic oligonucleotide
cacagacacggaaaggucgc

SEQ ID NO: 746 - RNA, 20 nt, Artificial Sequence
  Description of Artificial Sequence: Synthetic oligonucleotide
ucacagacacggaaaggucg

SEQ ID NO: 747 - RNA, 20 nt, Artificial Sequence
  Description of Artificial Sequence: Synthetic oligonucleotide
aucacagacacggaaagguc

SEQ ID NO: 748 - RNA, 20 nt, Artificial Sequence
  Description of Artificial Sequence: Synthetic oligonucleotide
gaucacagacacggaaaggu

SEQ ID NO: 749 - RNA, 20 nt, Artificial Sequence
  Description of Artificial Sequence: Synthetic oligonucleotide
uuggccuacuuacuuuggcu

SEQ ID NO: 750 - RNA, 20 nt, Artificial Sequence
  Description of Artificial Sequence: Synthetic oligonucleotide
cuuggccuacuuacuuuggc

SEQ ID NO: 751 - RNA, 20 nt, Artificial Sequence
  Description of Artificial Sequence: Synthetic oligonucleotide
acuuggccuacuuacuuugg

SEQ ID NO: 752 - RNA, 20 nt, Artificial Sequence
  Description of Artificial Sequence: Synthetic oligonucleotide
gaggaacuuggccuacuuac

SEQ ID NO: 753 - RNA, 20 nt, Artificial Sequence
  Description of Artificial Sequence: Synthetic oligonucleotide
cgaggaacuuggccuacuua

SEQ ID NO: 754 - RNA, 20 nt, Artificial Sequence
  Description of Artificial Sequence: Synthetic oligonucleotide
ccgaggaacuuggccuacuu

SEQ ID NO: 755 - RNA, 20 nt, Artificial Sequence
  Description of Artificial Sequence: Synthetic oligonucleotide
accgaggaacuuggccuacu

SEQ ID NO: 756 - RNA, 20 nt, Artificial Sequence
  Description of Artificial Sequence: Synthetic oligonucleotide
aaccgaggaacuuggccuac

SEQ ID NO: 757 - RNA, 20 nt, Artificial Sequence
  Description of Artificial Sequence: Synthetic oligonucleotide
gaaccgaggaacuuggccua

SEQ ID NO: 758 - RNA, 20 nt, Artificial Sequence
  Description of Artificial Sequence: Synthetic oligonucleotide
ggaaccgaggaacuuggccu

SEQ ID NO: 759 - RNA, 20 nt, Artificial Sequence
  Description of Artificial Sequence: Synthetic oligonucleotide
aggaaccgaggaacuuggcc

SEQ ID NO: 760 - RNA, 20 nt, Artificial Sequence
  Description of Artificial Sequence: Synthetic oligonucleotide
uaggaaccgaggaacuuggc

SEQ ID NO: 761 - RNA, 20 nt, Artificial Sequence
  Description of Artificial Sequence: Synthetic oligonucleotide
auaggaaccgaggaacuugg

SEQ ID NO: 762 - RNA, 20 nt, Artificial Sequence
  Description of Artificial Sequence: Synthetic oligonucleotide
uauaggaaccgaggaacuug

SEQ ID NO: 763 - RNA, 20 nt, Artificial Sequence
  Description of Artificial Sequence: Synthetic oligonucleotide
aucacaaguugccacuguug

SEQ ID NO: 764 - RNA, 20 nt, Artificial Sequence
  Description of Artificial Sequence: Synthetic oligonucleotide
caucacaaguugccacuguu

SEQ ID NO: 765 - RNA, 20 nt, Artificial Sequence
  Description of Artificial Sequence: Synthetic oligonucleotide
aucaucacaaguugccacug

SEQ ID NO: 766 - RNA, 20 nt, Artificial Sequence
  Description of Artificial Sequence: Synthetic oligonucleotide
caucaucacaaguugccacu

SEQ ID NO: 767 - RNA, 20 nt, Artificial Sequence
  Description of Artificial Sequence: Synthetic oligonucleotide
cugcuccaucaucacaaguu

SEQ ID NO: 768 - RNA, 20 nt, Artificial Sequence
  Description of Artificial Sequence: Synthetic oligonucleotide
ucugcuccaucaucacaagu

SEQ ID NO: 769 - RNA, 20 nt, Artificial Sequence
  Description of Artificial Sequence: Synthetic oligonucleotide
cccucugcuccaucaucaca

SEQ ID NO: 770 - RNA, 20 nt, Artificial Sequence
  Description of Artificial Sequence: Synthetic oligonucleotide
ucagcccucugcuccaucau

SEQ ID NO: 771 - RNA, 20 nt, Artificial Sequence
  Description of Artificial Sequence: Synthetic oligonucleotide
ugacuucagcccucugcucc

SEQ ID NO: 772 - RNA, 20 nt, Artificial Sequence
  Description of Artificial Sequence: Synthetic oligonucleotide
gugacuucagcccucugcuc

SEQ ID NO: 773 - RNA, 20 nt, Artificial Sequence
  Description of Artificial Sequence: Synthetic oligonucleotide
ugugacuucagcccucugcu

SEQ ID NO: 774 - RNA, 20 nt, Artificial Sequence
  Description of Artificial Sequence: Synthetic oligonucleotide
gugugacuucagcccucugc

SEQ ID NO: 775 - RNA, 20 nt, Artificial Sequence
  Description of Artificial Sequence: Synthetic oligonucleotide
ugugugacuucagcccucug

SEQ ID NO: 776 - RNA, 20 nt, Artificial Sequence
  Description of Artificial Sequence: Synthetic oligonucleotide
gcccacuccgcugcuuuuag

SEQ ID NO: 777 - RNA, 20 nt, Artificial Sequence
  Description of Artificial Sequence: Synthetic oligonucleotide
ggcccacuccgcugcuuuua

SEQ ID NO: 778 - RNA, 20 nt, Artificial Sequence
  Description of Artificial Sequence: Synthetic oligonucleotide
aggcccacuccgcugcuuuu

SEQ ID NO: 779 - RNA, 20 nt, Artificial Sequence
  Description of Artificial Sequence: Synthetic oligonucleotide
uaggcccacuccgcugcuuu

SEQ ID NO: 780 - RNA, 20 nt, Artificial Sequence
  Description of Artificial Sequence: Synthetic oligonucleotide
uuaggcccacuccgcugcuu

SEQ ID NO: 781 - RNA, 20 nt, Artificial Sequence
  Description of Artificial Sequence: Synthetic oligonucleotide
auuaggcccacuccgcugcu

SEQ ID NO: 782 - RNA, 20 nt, Artificial Sequence
  Description of Artificial Sequence: Synthetic oligonucleotide
ucauuaggcccacuccgcug

SEQ ID NO: 783 - RNA, 20 nt, Artificial Sequence
  Description of Artificial Sequence: Synthetic oligonucleotide
cucauuaggcccacuccgcu

SEQ ID NO: 784 - RNA, 20 nt, Artificial Sequence
  Description of Artificial Sequence: Synthetic oligonucleotide
agcucauuaggcccacuccg

SEQ ID NO: 785 - RNA, 20 nt, Artificial Sequence
  Description of Artificial Sequence: Synthetic oligonucleotide
cucccauagaaaagcucacu

SEQ ID NO: 786 - RNA, 20 nt, Artificial Sequence
  Description of Artificial Sequence: Synthetic oligonucleotide
gcucccauagaaaagcucac

SEQ ID NO: 787 - RNA, 20 nt, Artificial Sequence
  Description of Artificial Sequence: Synthetic oligonucleotide
ugcucccauagaaaagcuca

SEQ ID NO: 788 - RNA, 20 nt, Artificial Sequence
  Description of Artificial Sequence: Synthetic oligonucleotide
cugcucccauagaaaagcuc

SEQ ID NO: 789 - RNA, 20 nt, Artificial Sequence
  Description of Artificial Sequence: Synthetic oligonucleotide
ccugcucccauagaaaagcu

SEQ ID NO: 790 - RNA, 20 nt, Artificial Sequence
  Description of Artificial Sequence: Synthetic oligonucleotide
ucccuaucuccugcuaaccc

SEQ ID NO: 791 - RNA, 20 nt, Artificial Sequence
  Description of Artificial Sequence: Synthetic oligonucleotide
ccucgaacucucccuaucuc

SEQ ID NO: 792 - RNA, 20 nt, Artificial Sequence
  Description of Artificial Sequence: Synthetic oligonucleotide
cccucgaacucucccuaucu

SEQ ID NO: 793 - RNA, 20 nt, Artificial Sequence
  Description of Artificial Sequence: Synthetic oligonucleotide
ucccucgaacucucccuauc

SEQ ID NO: 794 - RNA, 20 nt, Artificial Sequence
  Description of Artificial Sequence: Synthetic oligonucleotide
gucccucgaacucucccuau

SEQ ID NO: 795 - RNA, 20 nt, Artificial Sequence
  Description of Artificial Sequence: Synthetic oligonucleotide
cuuuccauacuagcuucuga

SEQ ID NO: 796 - RNA, 20 nt, Artificial Sequence
  Description of Artificial Sequence: Synthetic oligonucleotide
ccuuuccauacuagcuucug

SEQ ID NO: 797 - RNA, 20 nt, Artificial Sequence
  Description of Artificial Sequence: Synthetic oligonucleotide
accuuuccauacuagcuucu

SEQ ID NO: 798 - RNA, 20 nt, Artificial Sequence
  Description of Artificial Sequence: Synthetic oligonucleotide
cacacaaaucaccuuuccau

SEQ ID NO: 799 - RNA, 20 nt, Artificial Sequence
  Description of Artificial Sequence: Synthetic oligonucleotide
gucacacaaaucaccuuucc

SEQ ID NO: 800 - RNA, 20 nt, Artificial Sequence
  Description of Artificial Sequence: Synthetic oligonucleotide
ugucacacaaaucaccuuuc

SEQ ID NO: 801 - RNA, 20 nt, Artificial Sequence
  Description of Artificial Sequence: Synthetic oligonucleotide
uuugacaggcaggaaguggc

SEQ ID NO: 802 - RNA, 20 nt, Artificial Sequence
  Description of Artificial Sequence: Synthetic oligonucleotide
gguuugacaggcaggaagug

SEQ ID NO: 803 - RNA, 20 nt, Artificial Sequence
  Description of Artificial Sequence: Synthetic oligonucleotide
agguuugacaggcaggaagu

SEQ ID NO: 804 - RNA, 20 nt, Artificial Sequence
  Description of Artificial Sequence: Synthetic oligonucleotide
aagguuugacaggcaggaag

SEQ ID NO: 805 - RNA, 20 nt, Artificial Sequence
  Description of Artificial Sequence: Synthetic oligonucleotide
aacuucccaagguuugacag

SEQ ID NO: 806 - RNA, 20 nt, Artificial Sequence
  Description of Artificial Sequence: Synthetic oligonucleotide
caacuucccaagguuugaca

SEQ ID NO: 807 - RNA, 20 nt, Artificial Sequence
  Description of Artificial Sequence: Synthetic oligonucleotide
gaacaacuucccaagguuug

SEQ ID NO: 808 - RNA, 20 nt, Artificial Sequence
  Description of Artificial Sequence: Synthetic oligonucleotide
ugaacaacuucccaagguuu

SEQ ID NO: 809 - RNA, 20 nt, Artificial Sequence
  Description of Artificial Sequence: Synthetic oligonucleotide
guagguugaacaacuuccca

SEQ ID NO: 810 - RNA, 20 nt, Artificial Sequence
  Description of Artificial Sequence: Synthetic oligonucleotide
gguagguugaacaacuuccc

SEQ ID NO: 811 - RNA, 20 nt, Artificial Sequence
  Description of Artificial Sequence: Synthetic oligonucleotide
ugguagguugaacaacuucc

SEQ ID NO: 812 - RNA, 20 nt, Artificial Sequence
  Description of Artificial Sequence: Synthetic oligonucleotide
gguuuugguagguugaacaa

SEQ ID NO: 813 - RNA, 20 nt, Artificial Sequence
  Description of Artificial Sequence: Synthetic oligonucleotide
ugagguuuugguagguugaa

SEQ ID NO: 814 - RNA, 20 nt, Artificial Sequence
  Description of Artificial Sequence: Synthetic oligonucleotide
cugagguuuugguagguuga

SEQ ID NO: 815 - RNA, 20 nt, Artificial Sequence
  Description of Artificial Sequence: Synthetic oligonucleotide
ccuacauuauccucuuacuc

SEQ ID NO: 816 - RNA, 20 nt, Artificial Sequence
  Description of Artificial Sequence: Synthetic oligonucleotide
ggacuuuaccuacauuaucc

SEQ ID NO: 817 - RNA, 20 nt, Artificial Sequence
  Description of Artificial Sequence: Synthetic oligonucleotide
guaugaggacuuuaccuaca

SEQ ID NO: 818 - RNA, 20 nt, Artificial Sequence
  Description of Artificial Sequence: Synthetic oligonucleotide
gccagguaugaggacuuuac

SEQ ID NO: 819 - RNA, 20 nt, Artificial Sequence
  Description of Artificial Sequence: Synthetic oligonucleotide
ugccagguaugaggacuuua

SEQ ID NO: 820 - RNA, 20 nt, Artificial Sequence
  Description of Artificial Sequence: Synthetic oligonucleotide
gugccagguaugaggacuuu

SEQ ID NO: 821 - RNA, 20 nt, Artificial Sequence
  Description of Artificial Sequence: Synthetic oligonucleotide
cugugccagguaugaggacu

SEQ ID NO: 822 - RNA, 20 nt, Artificial Sequence
  Description of Artificial Sequence: Synthetic oligonucleotide
ucugugccagguaugaggac

SEQ ID NO: 823 - RNA, 20 nt, Artificial Sequence
  Description of Artificial Sequence: Synthetic oligonucleotide
ccucaagaguucuccagaag

SEQ ID NO: 824 - RNA, 20 nt, Artificial Sequence
  Description of Artificial Sequence: Synthetic oligonucleotide
cccucaagaguucuccagaa

SEQ ID NO: 825 - RNA, 20 nt, Artificial Sequence
  Description of Artificial Sequence: Synthetic oligonucleotide
acccucaagaguucuccaga

SEQ ID NO: 826 - RNA, 20 nt, Artificial Sequence
  Description of Artificial Sequence: Synthetic oligonucleotide
acacccucaagaguucucca

SEQ ID NO: 827 - RNA, 20 nt, Artificial Sequence
  Description of Artificial Sequence: Synthetic oligonucleotide
cacacccucaagaguucucc

SEQ ID NO: 828 - RNA, 20 nt, Artificial Sequence
  Description of Artificial Sequence: Synthetic oligonucleotide
ccacacccucaagaguucuc

SEQ ID NO: 829 - RNA, 20 nt, Artificial Sequence
  Description of Artificial Sequence: Synthetic oligonucleotide
cccacacccucaagaguucu

SEQ ID NO: 830 - RNA, 20 nt, Artificial Sequence
  Description of Artificial Sequence: Synthetic oligonucleotide
uucccacacccucaagaguu

SEQ ID NO: 831 - RNA, 20 nt, Artificial Sequence
  Description of Artificial Sequence: Synthetic oligonucleotide
caaugcugcaccucacuucc

SEQ ID NO: 832 - RNA, 20 nt, Artificial Sequence
  Description of Artificial Sequence: Synthetic oligonucleotide
uacaaugcugcaccucacuu

SEQ ID NO: 833 - RNA, 20 nt, Artificial Sequence
  Description of Artificial Sequence: Synthetic oligonucleotide
cuacaaugcugcaccucacu

SEQ ID NO: 834 - RNA, 20 nt, Artificial Sequence
  Description of Artificial Sequence: Synthetic oligonucleotide
ucuacaaugcugcaccucac

SEQ ID NO: 835 - RNA, 20 nt, Artificial Sequence
  Description of Artificial Sequence: Synthetic oligonucleotide
aucuacaaugcugcaccuca

SEQ ID NO: 836 - RNA, 20 nt, Artificial Sequence
  Description of Artificial Sequence: Synthetic oligonucleotide
uaucuacaaugcugcaccuc

SEQ ID NO: 837 - RNA, 20 nt, Artificial Sequence
  Description of Artificial Sequence: Synthetic oligonucleotide
cuuaucuacaaugcugcacc

SEQ ID NO: 838 - RNA, 20 nt, Artificial Sequence
  Description of Artificial Sequence: Synthetic oligonucleotide
gucuuaucuacaaugcugca

SEQ ID NO: 839 - RNA, 20 nt, Artificial Sequence
  Description of Artificial Sequence: Synthetic oligonucleotide
ugucuuaucuacaaugcugc

SEQ ID NO: 840 - RNA, 20 nt, Artificial Sequence
  Description of Artificial Sequence: Synthetic oligonucleotide
cugucuuaucuacaaugcug

SEQ ID NO: 841 - RNA, 20 nt, Artificial Sequence
  Description of Artificial Sequence: Synthetic oligonucleotide
cacccuucugucuuaucuac

SEQ ID NO: 842 - RNA, 20 nt, Artificial Sequence
  Description of Artificial Sequence: Synthetic oligonucleotide
uccacccuucugucuuaucu

SEQ ID NO: 843 - RNA, 20 nt, Artificial Sequence
  Description of Artificial Sequence: Synthetic oligonucleotide
guccacccuucugucuuauc

SEQ ID NO: 844 - RNA, 20 nt, Artificial Sequence
  Description of Artificial Sequence: Synthetic oligonucleotide
aguccacccuucugucuuau

SEQ ID NO: 845 - RNA, 20 nt, Artificial Sequence
  Description of Artificial Sequence: Synthetic oligonucleotide
aaguccacccuucugucuua

SEQ ID NO: 846 - RNA, 20 nt, Artificial Sequence
  Description of Artificial Sequence: Synthetic oligonucleotide
gaaagcaagccagguucuca

SEQ ID NO: 847 - RNA, 20 nt, Artificial Sequence
  Description of Artificial Sequence: Synthetic oligonucleotide
ggaaagcaagccagguucuc

SEQ ID NO: 848 - RNA, 20 nt, Artificial Sequence
  Description of Artificial Sequence: Synthetic oligonucleotide
ggaauuggaaagcaagccag

SEQ ID NO: 849 - RNA, 20 nt, Artificial Sequence
  Description of Artificial Sequence: Synthetic oligonucleotide
accaugucauuggcaucucc

SEQ ID NO: 850 - RNA, 20 nt, Artificial Sequence
  Description of Artificial Sequence: Synthetic oligonucleotide
uaccaugucauuggcaucuc

SEQ ID NO: 851 - RNA, 20 nt, Artificial Sequence
  Description of Artificial Sequence: Synthetic oligonucleotide
ccuaccaugucauuggcauc

SEQ ID NO: 852 - RNA, 20 nt, Artificial Sequence
  Description of Artificial Sequence: Synthetic oligonucleotide
uccuaccaugucauuggcau

SEQ ID NO: 853 - RNA, 20 nt, Artificial Sequence
  Description of Artificial Sequence: Synthetic oligonucleotide
cuccuaccaugucauuggca

SEQ ID NO: 854 - RNA, 20 nt, Artificial Sequence
  Description of Artificial Sequence: Synthetic oligonucleotide
gcuccuaccaugucauuggc

SEQ ID NO: 855 - RNA, 20 nt, Artificial Sequence
  Description of Artificial Sequence: Synthetic oligonucleotide
ugcuccuaccaugucauugg

SEQ ID NO: 856 - RNA, 20 nt, Artificial Sequence
  Description of Artificial Sequence: Synthetic oligonucleotide
ucuuugcuccuaccauguca

SEQ ID NO: 857 - RNA, 20 nt, Artificial Sequence
  Description of Artificial Sequence: Synthetic oligonucleotide
ccucuuugcuccuaccaugu

SEQ ID NO: 858 - RNA, 20 nt, Artificial Sequence
  Description of Artificial Sequence: Synthetic oligonucleotide
uuccucuuugcuccuaccau

SEQ ID NO: 859 - RNA, 20 nt, Artificial Sequence
  Description of Artificial Sequence: Synthetic oligonucleotide
ucuccguguucuucaguuuu

SEQ ID NO: 860 - RNA, 20 nt, Artificial Sequence
  Description of Artificial Sequence: Synthetic oligonucleotide
cucuccguguucuucaguuu

SEQ ID NO: 861 - RNA, 20 nt, Artificial Sequence
  Description of Artificial Sequence: Synthetic oligonucleotide
agcucuccguguucuucagu

SEQ ID NO: 862 - RNA, 20 nt, Artificial Sequence
  Description of Artificial Sequence: Synthetic oligonucleotide
ugcagcucuccguguucuuc

SEQ ID NO: 863 - RNA, 20 nt, Artificial Sequence
  Description of Artificial Sequence: Synthetic oligonucleotide
gguugcagcucuccguguuc

SEQ ID NO: 864 - RNA, 20 nt, Artificial Sequence
  Description of Artificial Sequence: Synthetic oligonucleotide
agguugcagcucuccguguu

SEQ ID NO: 865 - RNA, 20 nt, Artificial Sequence
  Description of Artificial Sequence: Synthetic oligonucleotide
aaagguugcagcucuccgug

SEQ ID NO: 866 - RNA, 20 nt, Artificial Sequence
  Description of Artificial Sequence: Synthetic oligonucleotide
uaaagguugcagcucuccgu

SEQ ID NO: 867 - RNA, 20 nt, Artificial Sequence
  Description of Artificial Sequence: Synthetic oligonucleotide
cuaaagguugcagcucuccg

SEQ ID NO: 868 - RNA, 20 nt, Artificial Sequence
  Description of Artificial Sequence: Synthetic oligonucleotide
ccuaaagguugcagcucucc

SEQ ID NO: 869 - RNA, 20 nt, Artificial Sequence
  Description of Artificial Sequence: Synthetic oligonucleotide
uccuaaagguugcagcucuc

SEQ ID NO: 870 - RNA, 20 nt, Artificial Sequence
  Description of Artificial Sequence: Synthetic oligonucleotide
cuccuaaagguugcagcucu

SEQ ID NO: 871 - RNA, 20 nt, Artificial Sequence
  Description of Artificial Sequence: Synthetic oligonucleotide
ccuccuaaagguugcagcuc

SEQ ID NO: 872 - RNA, 20 nt, Artificial Sequence
  Description of Artificial Sequence: Synthetic oligonucleotide
gcacuuugauaccuccuaaa

SEQ ID NO: 873 - RNA, 20 nt, Artificial Sequence
  Description of Artificial Sequence: Synthetic oligonucleotide
ggcacuuugauaccuccuaa

SEQ ID NO: 874 - RNA, 20 nt, Artificial Sequence
  Description of Artificial Sequence: Synthetic oligonucleotide
gaugucccacuuugacuuuc

SEQ ID NO: 875 - RNA, 20 nt, Artificial Sequence
  Description of Artificial Sequence: Synthetic oligonucleotide
ucgaugucccacuuugacuu

SEQ ID NO: 876 - RNA, 20 nt, Artificial Sequence
  Description of Artificial Sequence: Synthetic oligonucleotide
gucgaugucccacuuugacu

SEQ ID NO: 877 - RNA, 20 nt, Artificial Sequence
  Description of Artificial Sequence: Synthetic oligonucleotide
ggucgaugucccacuuugac

SEQ ID NO: 878 - RNA, 20 nt, Artificial Sequence
  Description of Artificial Sequence: Synthetic oligonucleotide
uggucgaugucccacuuuga

SEQ ID NO: 879 - RNA, 20 nt, Artificial Sequence
  Description of Artificial Sequence: Synthetic oligonucleotide
uuggucgaugucccacuuug

SEQ ID NO: 880 - RNA, 20 nt, Artificial Sequence
  Description of Artificial Sequence: Synthetic oligonucleotide
auuggucgaugucccacuuu

SEQ ID NO: 881 - RNA, 20 nt, Artificial Sequence
  Description of Artificial Sequence: Synthetic oligonucleotide
cauuggucgaugucccacuu

SEQ ID NO: 882 - RNA, 20 nt, Artificial Sequence
  Description of Artificial Sequence: Synthetic oligonucleotide
aacauccaucaguuggcucu

SEQ ID NO: 883 - RNA, 20 nt, Artificial Sequence
  Description of Artificial Sequence: Synthetic oligonucleotide
cugcccaacauccaucaguu

SEQ ID NO: 884 - RNA, 20 nt, Artificial Sequence
  Description of Artificial Sequence: Synthetic oligonucleotide
agcugcccaacauccaucag

SEQ ID NO: 885 - RNA, 20 nt, Artificial Sequence
  Description of Artificial Sequence: Synthetic oligonucleotide
uagcugcccaacauccauca

SEQ ID NO: 886 - RNA, 20 nt, Artificial Sequence
  Description of Artificial Sequence: Synthetic oligonucleotide
uuagcugcccaacauccauc

SEQ ID NO: 887 - RNA, 20 nt, Artificial Sequence
  Description of Artificial Sequence: Synthetic oligonucleotide
uuuagcugcccaacauccau

SEQ ID NO: 888 - RNA, 20 nt, Artificial Sequence
  Description of Artificial Sequence: Synthetic oligonucleotide
cuuuagcugcccaacaucca

SEQ ID NO: 889 - RNA, 20 nt, Artificial Sequence
  Description of Artificial Sequence: Synthetic oligonucleotide
ccucuuuagcugcccaacau

SEQ ID NO: 890 - RNA, 20 nt, Artificial Sequence
  Description of Artificial Sequence: Synthetic oligonucleotide
cccucuuuagcugcccaaca

SEQ ID NO: 891 - RNA, 20 nt, Artificial Sequence
  Description of Artificial Sequence: Synthetic oligonucleotide
ucccucuuuagcugcccaac

SEQ ID NO: 892 - RNA, 20 nt, Artificial Sequence
  Description of Artificial Sequence: Synthetic oligonucleotide
uucccucuuuagcugcccaa

SEQ ID NO: 893 - RNA, 20 nt, Artificial Sequence
  Description of Artificial Sequence: Synthetic oligonucleotide
ccuucccucuuuagcugccc

SEQ ID NO: 894 - RNA, 20 nt, Artificial Sequence
  Description of Artificial Sequence: Synthetic oligonucleotide
cccuucccucuuuagcugcc

SEQ ID NO: 895 - RNA, 20 nt, Artificial Sequence
  Description of Artificial Sequence: Synthetic oligonucleotide
gcaggucuuaucccaugccc

SEQ ID NO: 896 - RNA, 20 nt, Artificial Sequence
  Description of Artificial Sequence: Synthetic oligonucleotide
gggcaggucuuaucccaugc

SEQ ID NO: 897 - RNA, 20 nt, Artificial Sequence
  Description of Artificial Sequence: Synthetic oligonucleotide
agggcaggucuuaucccaug

SEQ ID NO: 898 - RNA, 20 nt, Artificial Sequence
  Description of Artificial Sequence: Synthetic oligonucleotide
aagggcaggucuuaucccau

SEQ ID NO: 899 - RNA, 20 nt, Artificial Sequence
  Description of Artificial Sequence: Synthetic oligonucleotide
gaagggcaggucuuauccca

SEQ ID NO: 900 - RNA, 20 nt, Artificial Sequence
  Description of Artificial Sequence: Synthetic oligonucleotide
agaagggcaggucuuauccc

SEQ ID NO: 901 - RNA, 20 nt, Artificial Sequence
  Description of Artificial Sequence: Synthetic oligonucleotide
ccaauggcaagaagcaagaa

SEQ ID NO: 902 - RNA, 20 nt, Artificial Sequence
  Description of Artificial Sequence: Synthetic oligonucleotide
cccaauggcaagaagcaaga

SEQ ID NO: 903 - RNA, 20 nt, Artificial Sequence
  Description of Artificial Sequence: Synthetic oligonucleotide
gcccaauggcaagaagcaag

SEQ ID NO: 904 - RNA, 20 nt, Artificial Sequence
  Description of Artificial Sequence: Synthetic oligonucleotide
uccaaugccugcccaauggc

SEQ ID NO: 905 - RNA, 20 nt, Artificial Sequence
  Description of Artificial Sequence: Synthetic oligonucleotide
cuccaaugccugcccaaugg

SEQ ID NO: 906 - RNA, 20 nt, Artificial Sequence
  Description of Artificial Sequence: Synthetic oligonucleotide
ucuccaaugccugcccaaug

SEQ ID NO: 907 - RNA, 20 nt, Artificial Sequence
  Description of Artificial Sequence: Synthetic oligonucleotide
ggucuccaaugccugcccaa

SEQ ID NO: 908 - RNA, 20 nt, Artificial Sequence
  Description of Artificial Sequence: Synthetic oligonucleotide
uagggucuccaaugccugcc

SEQ ID NO: 909 - RNA, 20 nt, Artificial Sequence
  Description of Artificial Sequence: Synthetic oligonucleotide
guagggucuccaaugccugc

SEQ ID NO: 910 - RNA, 20 nt, Artificial Sequence
  Description of Artificial Sequence: Synthetic oligonucleotide
aguagggucuccaaugccug

SEQ ID NO: 911 - RNA, 20 nt, Artificial Sequence
  Description of Artificial Sequence: Synthetic oligonucleotide
caguagggucuccaaugccu

SEQ ID NO: 912 - RNA, 20 nt, Artificial Sequence
  Description of Artificial Sequence: Synthetic oligonucleotide
gcaguagggucuccaaugcc

SEQ ID NO: 913 - RNA, 20 nt, Artificial Sequence
  Description of Artificial Sequence: Synthetic oligonucleotide
agcaguagggucuccaaugc

SEQ ID NO: 914 - RNA, 20 nt, Artificial Sequence
  Description of Artificial Sequence: Synthetic oligonucleotide
cagcaguagggucuccaaug

SEQ ID NO: 915 - RNA, 20 nt, Artificial Sequence
  Description of Artificial Sequence: Synthetic oligonucleotide
ucagcaguagggucuccaau

SEQ ID NO: 916 - RNA, 20 nt, Artificial Sequence
  Description of Artificial Sequence: Synthetic oligonucleotide
auucagcaguagggucucca

SEQ ID NO: 917 - RNA, 20 nt, Artificial Sequence
  Description of Artificial Sequence: Synthetic oligonucleotide
cauucagcaguagggucucc

SEQ ID NO: 918 - RNA, 20 nt, Artificial Sequence
  Description of Artificial Sequence: Synthetic oligonucleotide
ccauucagcaguagggucuc

SEQ ID NO: 919 - RNA, 20 nt, Artificial Sequence
  Description of Artificial Sequence: Synthetic oligonucleotide
uccauucagcaguagggucu

SEQ ID NO: 920 - RNA, 20 nt, Artificial Sequence
  Description of Artificial Sequence: Synthetic oligonucleotide
acuccauucagcaguagggu

SEQ ID NO: 921 - RNA, 20 nt, Artificial Sequence
  Description of Artificial Sequence: Synthetic oligonucleotide
cacuccauucagcaguaggg

SEQ ID NO: 922 - RNA, 20 nt, Artificial Sequence
  Description of Artificial Sequence: Synthetic oligonucleotide
gcacuccauucagcaguagg

SEQ ID NO: 923 - RNA, 20 nt, Artificial Sequence
  Description of Artificial Sequence: Synthetic oligonucleotide
agcacuccauucagcaguag

SEQ ID NO: 924 - RNA, 20 nt, Artificial Sequence
  Description of Artificial Sequence: Synthetic oligonucleotide
uagcacuccauucagcagua

SEQ ID NO: 925 - RNA, 20 nt, Artificial Sequence
  Description of Artificial Sequence: Synthetic oligonucleotide
guuagcacuccauucagcag

SEQ ID NO: 926 - RNA, 20 nt, Artificial Sequence
  Description of Artificial Sequence: Synthetic oligonucleotide
gguuagcacuccauucagca

SEQ ID NO: 927 - RNA, 20 nt, Artificial Sequence
  Description of Artificial Sequence: Synthetic oligonucleotide
ggguuagcacuccauucagc

SEQ ID NO: 928 - RNA, 20 nt, Artificial Sequence
  Description of Artificial Sequence: Synthetic oligonucleotide
caggguuagcacuccauuca

SEQ ID NO: 929 - RNA, 20 nt, Artificial Sequence
  Description of Artificial Sequence: Synthetic oligonucleotide
ccaggguuagcacuccauuc

SEQ ID NO: 930 - RNA, 20 nt, Artificial Sequence
  Description of Artificial Sequence: Synthetic oligonucleotide
accaggguuagcacuccauu

SEQ ID NO: 931 - RNA, 20 nt, Artificial Sequence
  Description of Artificial Sequence: Synthetic oligonucleotide
caccaggguuagcacuccau

SEQ ID NO: 932 - RNA, 20 nt, Artificial Sequence
  Description of Artificial Sequence: Synthetic oligonucleotide
gcaccaggguuagcacucca

SEQ ID NO: 933 - RNA, 20 nt, Artificial Sequence
  Description of Artificial Sequence: Synthetic oligonucleotide
agcaccaggguuagcacucc

SEQ ID NO: 934 - RNA, 20 nt, Artificial Sequence
  Description of Artificial Sequence: Synthetic oligonucleotide
uagcaccaggguuagcacuc

SEQ ID NO: 935 - RNA, 20 nt, Artificial Sequence
  Description of Artificial Sequence: Synthetic oligonucleotide
cuagcaccaggguuagcacu

SEQ ID NO: 936 - RNA, 20 nt, Artificial Sequence
  Description of Artificial Sequence: Synthetic oligonucleotide
ucuagcaccaggguuagcac

SEQ ID NO: 937 - RNA, 20 nt, Artificial Sequence
  Description of Artificial Sequence: Synthetic oligonucleotide
cucuagcaccaggguuagca

SEQ ID NO: 938 - RNA, 20 nt, Artificial Sequence
  Description of Artificial Sequence: Synthetic oligonucleotide
ccucuagcaccaggguuagc

SEQ ID NO: 939 - RNA, 20 nt, Artificial Sequence
  Description of Artificial Sequence: Synthetic oligonucleotide
uccucuagcaccaggguuag

SEQ ID NO: 940 - RNA, 20 nt, Artificial Sequence
  Description of Artificial Sequence: Synthetic oligonucleotide
cuccucuagcaccaggguua

SEQ ID NO: 941 - RNA, 20 nt, Artificial Sequence
  Description of Artificial Sequence: Synthetic oligonucleotide
ccuccucuagcaccaggguu

SEQ ID NO: 942 - RNA, 20 nt, Artificial Sequence
  Description of Artificial Sequence: Synthetic oligonucleotide
uccuccucuagcaccagggu

SEQ ID NO: 943 - RNA, 20 nt, Artificial Sequence
  Description of Artificial Sequence: Synthetic oligonucleotide
guuccauccuccucuagcac

SEQ ID NO: 944 - RNA, 20 nt, Artificial Sequence
  Description of Artificial Sequence: Synthetic oligonucleotide
aaguccucacuguccacugc

SEQ ID NO: 945 - RNA, 20 nt, Artificial Sequence
  Description of Artificial Sequence: Synthetic oligonucleotide
gaaguccucacuguccacug

SEQ ID NO: 946 - RNA, 20 nt, Artificial Sequence
  Description of Artificial Sequence: Synthetic oligonucleotide
agaaguccucacuguccacu

SEQ ID NO: 947 - RNA, 20 nt, Artificial Sequence
  Description of Artificial Sequence: Synthetic oligonucleotide
aagaaguccucacuguccac

SEQ ID NO: 948 - RNA, 20 nt, Artificial Sequence
  Description of Artificial Sequence: Synthetic oligonucleotide
gaagaaguccucacugucca

SEQ ID NO: 949 - RNA, 20 nt, Artificial Sequence
  Description of Artificial Sequence: Synthetic oligonucleotide
ggaagaaguccucacugucc

SEQ ID NO: 950 - RNA, 20 nt, Artificial Sequence
  Description of Artificial Sequence: Synthetic oligonucleotide
uggaagaaguccucacuguc

SEQ ID NO: 951 - RNA, 20 nt, Artificial Sequence
  Description of Artificial Sequence: Synthetic oligonucleotide
cuggaagaaguccucacugu

SEQ ID NO: 952 - RNA, 20 nt, Artificial Sequence
  Description of Artificial Sequence: Synthetic oligonucleotide
agcuggaagaaguccucacu

SEQ ID NO: 953 - RNA, 20 nt, Artificial Sequence
  Description of Artificial Sequence: Synthetic oligonucleotide
acugcaacaccaucaggcac

SEQ ID NO: 954 - RNA, 20 nt, Artificial Sequence
  Description of Artificial Sequence: Synthetic oligonucleotide
gacugcaacaccaucaggca

SEQ ID NO: 955 - RNA, 20 nt, Artificial Sequence
  Description of Artificial Sequence: Synthetic oligonucleotide
agacugcaacaccaucaggc

SEQ ID NO: 956 - RNA, 20 nt, Artificial Sequence
  Description of Artificial Sequence: Synthetic oligonucleotide
cagacugcaacaccaucagg

SEQ ID NO: 957 - RNA, 20 nt, Artificial Sequence
  Description of Artificial Sequence: Synthetic oligonucleotide
ccagacugcaacaccaucag

SEQ ID NO: 958 - RNA, 20 nt, Artificial Sequence
  Description of Artificial Sequence: Synthetic oligonucleotide
gaccagacugcaacaccauc

SEQ ID NO: 959 - RNA, 20 nt, Artificial Sequence
  Description of Artificial Sequence: Synthetic oligonucleotide
cucugaccagacugcaacac

SEQ ID NO: 960 - RNA, 20 nt, Artificial Sequence
  Description of Artificial Sequence: Synthetic oligonucleotide
agcucugaccagacugcaac

SEQ ID NO: 961 - RNA, 20 nt, Artificial Sequence
  Description of Artificial Sequence: Synthetic oligonucleotide
ccagcucugaccagacugca

SEQ ID NO: 962 - RNA, 20 nt, Artificial Sequence
  Description of Artificial Sequence: Synthetic oligonucleotide
uguagggcuccagcucugac

SEQ ID NO: 963 - RNA, 20 nt, Artificial Sequence
  Description of Artificial Sequence: Synthetic oligonucleotide
cuuguagggcuccagcucug

SEQ ID NO: 964 - RNA, 20 nt, Artificial Sequence
  Description of Artificial Sequence: Synthetic oligonucleotide
ccuuguagggcuccagcucu

SEQ ID NO: 965 - RNA, 20 nt, Artificial Sequence
  Description of Artificial Sequence: Synthetic oligonucleotide
acaggcauuggaagcagccc

SEQ ID NO: 966 - RNA, 20 nt, Artificial Sequence
  Description of Artificial Sequence: Synthetic oligonucleotide
gacaggcauuggaagcagcc

SEQ ID NO: 967 - RNA, 20 nt, Artificial Sequence
  Description of Artificial Sequence: Synthetic oligonucleotide
aaggacaggcauuggaagca

SEQ ID NO: 968 - RNA, 20 nt, Artificial Sequence
  Description of Artificial Sequence: Synthetic oligonucleotide
aaaggacaggcauuggaagc

SEQ ID NO: 969 - RNA, 20 nt, Artificial Sequence
  Description of Artificial Sequence: Synthetic oligonucleotide
uaaaggacaggcauuggaag

SEQ ID NO: 970 - RNA, 20 nt, Artificial Sequence
  Description of Artificial Sequence: Synthetic oligonucleotide
cuaaaggacaggcauuggaa

SEQ ID NO: 971 - RNA, 20 nt, Artificial Sequence
  Description of Artificial Sequence: Synthetic oligonucleotide
gcucuaaaggacaggcauug

SEQ ID NO: 972 - RNA, 20 nt, Artificial Sequence
  Description of Artificial Sequence: Synthetic oligonucleotide
agcucuaaaggacaggcauu

SEQ ID NO: 973 - RNA, 20 nt, Artificial Sequence
  Description of Artificial Sequence: Synthetic oligonucleotide
aagcucuaaaggacaggcau

SEQ ID NO: 974 - RNA, 20 nt, Artificial Sequence
  Description of Artificial Sequence: Synthetic oligonucleotide
aaagcucuaaaggacaggca

SEQ ID NO: 975 - RNA, 20 nt, Artificial Sequence
  Description of Artificial Sequence: Synthetic oligonucleotide
gaaagcucuaaaggacaggc

SEQ ID NO: 976 - RNA, 20 nt, Artificial Sequence
  Description of Artificial Sequence: Synthetic oligonucleotide
cgggaaagcucuaaaggaca

SEQ ID NO: 977 - RNA, 20 nt, Artificial Sequence
  Description of Artificial Sequence: Synthetic oligonucleotide
ccgggaaagcucuaaaggac

SEQ ID NO: 978 - RNA, 20 nt, Artificial Sequence
  Description of Artificial Sequence: Synthetic oligonucleotide
aggguuaagcuagagaggaa

SEQ ID NO: 979 - RNA, 20 nt, Artificial Sequence
  Description of Artificial Sequence: Synthetic oligonucleotide
ucaggguuaagcuagagagg

SEQ ID NO: 980 - RNA, 20 nt, Artificial Sequence
  Description of Artificial Sequence: Synthetic oligonucleotide
gaucaggguuaagcuagaga

SEQ ID NO: 981 - RNA, 20 nt, Artificial Sequence
  Description of Artificial Sequence: Synthetic oligonucleotide
ggaucaggguuaagcuagag

SEQ ID NO: 982 - RNA, 20 nt, Artificial Sequence
  Description of Artificial Sequence: Synthetic oligonucleotide
aggaucaggguuaagcuaga

SEQ ID NO: 983 - RNA, 20 nt, Artificial Sequence
  Description of Artificial Sequence: Synthetic oligonucleotide
cccaggaucaggguuaagcu

SEQ ID NO: 984 - RNA, 20 nt, Artificial Sequence
  Description of Artificial Sequence: Synthetic oligonucleotide
caacuccuccugcaccuggu

SEQ ID NO: 985 - RNA, 20 nt, Artificial Sequence
  Description of Artificial Sequence: Synthetic oligonucleotide
acaacuccuccugcaccugg

SEQ ID NO: 986 - RNA, 20 nt, Artificial Sequence
  Description of Artificial Sequence: Synthetic oligonucleotide
gacaauuccacaacuccucc

SEQ ID NO: 987 - RNA, 20 nt, Artificial Sequence
  Description of Artificial Sequence: Synthetic oligonucleotide
ugacaauuccacaacuccuc

SEQ ID NO: 988 - RNA, 20 nt, Artificial Sequence
  Description of Artificial Sequence: Synthetic oligonucleotide
uugacaauuccacaacuccu

SEQ ID NO: 989 - RNA, 20 nt, Artificial Sequence
  Description of Artificial Sequence: Synthetic oligonucleotide
cuugacaauuccacaacucc

SEQ ID NO: 990 - RNA, 20 nt, Artificial Sequence
  Description of Artificial Sequence: Synthetic oligonucleotide
uccuugacaauuccacaacu

SEQ ID NO: 991 - RNA, 20 nt, Artificial Sequence
  Description of Artificial Sequence: Synthetic oligonucleotide
auccuugacaauuccacaac

SEQ ID NO: 992 - RNA, 20 nt, Artificial Sequence
  Description of Artificial Sequence: Synthetic oligonucleotide
cauccuugacaauuccacaa

SEQ ID NO: 993 - RNA, 20 nt, Artificial Sequence
  Description of Artificial Sequence: Synthetic oligonucleotide
acauccuugacaauuccaca

SEQ ID NO: 994 - RNA, 20 nt, Artificial Sequence
  Description of Artificial Sequence: Synthetic oligonucleotide
gacauccuugacaauuccac

SEQ ID NO: 995 - RNA, 20 nt, Artificial Sequence
  Description of Artificial Sequence: Synthetic oligonucleotide
ugacauccuugacaauucca

SEQ ID NO: 996 - RNA, 20 nt, Artificial Sequence
  Description of Artificial Sequence: Synthetic oligonucleotide
ugugugacauccuugacaau

SEQ ID NO: 997 - RNA, 20 nt, Artificial Sequence
  Description of Artificial Sequence: Synthetic oligonucleotide
acugugugacauccuugaca

SEQ ID NO: 998 - RNA, 20 nt, Artificial Sequence
  Description of Artificial Sequence: Synthetic oligonucleotide
acuuucuguccacuguguga

SEQ ID NO: 999 - RNA, 20 nt, Artificial Sequence
  Description of Artificial Sequence: Synthetic oligonucleotide
ccucgcuuggacuuucuguc

SEQ ID NO: 1000 - RNA, 20 nt, Artificial Sequence
  Description of Artificial Sequence: Synthetic oligonucleotide
cccucgcuuggacuuucugu

SEQ ID NO: 1001 - RNA, 20 nt, Artificial Sequence
  Description of Artificial Sequence: Synthetic oligonucleotide
ucccucgcuuggacuuucug

SEQ ID NO: 1002 - RNA, 20 nt, Artificial Sequence
  Description of Artificial Sequence: Synthetic oligonucleotide
cucccucgcuuggacuuucu

SEQ ID NO: 1003 - RNA, 20 nt, Artificial Sequence
  Description of Artificial Sequence: Synthetic oligonucleotide
ccucccucgcuuggacuuuc

SEQ ID NO: 1004 - RNA, 20 nt, Artificial Sequence
  Description of Artificial Sequence: Synthetic oligonucleotide
cccucccucgcuuggacuuu

SEQ ID NO: 1005 - RNA, 20 nt, Artificial Sequence
  Description of Artificial Sequence: Synthetic oligonucleotide
uccaucagcacugggucaga

SEQ ID NO: 1006 - RNA, 20 nt, Artificial Sequence
  Description of Artificial Sequence: Synthetic oligonucleotide
accacuaaucuccaucagca

SEQ ID NO: 1007 - RNA, 20 nt, Artificial Sequence
  Description of Artificial Sequence: Synthetic oligonucleotide
caccacuaaucuccaucagc

SEQ ID NO: 1008 - RNA, 20 nt, Artificial Sequence
  Description of Artificial Sequence: Synthetic oligonucleotide
ccaccacuaaucuccaucag

SEQ ID NO: 1009 - RNA, 20 nt, Artificial Sequence
  Description of Artificial Sequence: Synthetic oligonucleotide
cccaccacuaaucuccauca

SEQ ID NO: 1010 - RNA, 20 nt, Artificial Sequence
  Description of Artificial Sequence: Synthetic oligonucleotide
accagacacccaccacuaau

SEQ ID NO: 1011 - RNA, 20 nt, Artificial Sequence
  Description of Artificial Sequence: Synthetic oligonucleotide
uaccagacacccaccacuaa

SEQ ID NO: 1012 - RNA, 20 nt, Artificial Sequence
  Description of Artificial Sequence: Synthetic oligonucleotide
cucauaccagacacccacca

SEQ ID NO: 1013 - RNA, 20 nt, Artificial Sequence
  Description of Artificial Sequence: Synthetic oligonucleotide
ccucauaccagacacccacc

SEQ ID NO: 1014 - RNA, 20 nt, Artificial Sequence
  Description of Artificial Sequence: Synthetic oligonucleotide
uccucauaccagacacccac

SEQ ID NO: 1015 - RNA, 20 nt, Artificial Sequence
  Description of Artificial Sequence: Synthetic oligonucleotide
auccucauaccagacaccca

SEQ ID NO: 1016 - RNA, 20 nt, Artificial Sequence
  Description of Artificial Sequence: Synthetic oligonucleotide
gauccucauaccagacaccc

SEQ ID NO: 1017 - RNA, 20 nt, Artificial Sequence
  Description of Artificial Sequence: Synthetic oligonucleotide
agauccucauaccagacacc

SEQ ID NO: 1018 - RNA, 20 nt, Artificial Sequence
  Description of Artificial Sequence: Synthetic oligonucleotide
uagauccucauaccagacac

SEQ ID NO: 1019 - RNA, 20 nt, Artificial Sequence
  Description of Artificial Sequence: Synthetic oligonucleotide
guagauccucauaccagaca

SEQ ID NO: 1020 - RNA, 20 nt, Artificial Sequence
  Description of Artificial Sequence: Synthetic oligonucleotide
aguagauccucauaccagac

SEQ ID NO: 1021 - RNA, 20 nt, Artificial Sequence
  Description of Artificial Sequence: Synthetic oligonucleotide
caguagauccucauaccaga

SEQ ID NO: 1022 - RNA, 20 nt, Artificial Sequence
  Description of Artificial Sequence: Synthetic oligonucleotide
ugcaguagauccucauacca

SEQ ID NO: 1023 - RNA, 20 nt, Artificial Sequence
  Description of Artificial Sequence: Synthetic oligonucleotide
gugcaguagauccucauacc

SEQ ID NO: 1024 - RNA, 20 nt, Artificial Sequence
  Description of Artificial Sequence: Synthetic oligonucleotide
agugcaguagauccucauac

SEQ ID NO: 1025 - RNA, 20 nt, Artificial Sequence
  Description of Artificial Sequence: Synthetic oligonucleotide
acucuguaggacacccuugu

SEQ ID NO: 1026 - RNA, 20 nt, Artificial Sequence
  Description of Artificial Sequence: Synthetic oligonucleotide
cacucuguaggacacccuug

SEQ ID NO: 1027 - RNA, 20 nt, Artificial Sequence
  Description of Artificial Sequence: Synthetic oligonucleotide
ccacucuguaggacacccuu

SEQ ID NO: 1028 - RNA, 20 nt, Artificial Sequence
  Description of Artificial Sequence: Synthetic oligonucleotide
uccacucuguaggacacccu

SEQ ID NO: 1029 - RNA, 20 nt, Artificial Sequence
  Description of Artificial Sequence: Synthetic oligonucleotide
cuccacucuguaggacaccc

SEQ ID NO: 1030 - RNA, 20 nt, Artificial Sequence
  Description of Artificial Sequence: Synthetic oligonucleotide
acuccacucuguaggacacc

SEQ ID NO: 1031 - RNA, 20 nt, Artificial Sequence
  Description of Artificial Sequence: Synthetic oligonucleotide
cacuccacucuguaggacac

SEQ ID NO: 1032 - RNA, 20 nt, Artificial Sequence
  Description of Artificial Sequence: Synthetic oligonucleotide
agcacuccacucuguaggac

SEQ ID NO: 1033 - RNA, 20 nt, Artificial Sequence
  Description of Artificial Sequence: Synthetic oligonucleotide
uaugacagcacuccacucug

SEQ ID NO: 1034 - RNA, 20 nt, Artificial Sequence
  Description of Artificial Sequence: Synthetic oligonucleotide
auaugacagcacuccacucu

SEQ ID NO: 1035 - RNA, 20 nt, Artificial Sequence
  Description of Artificial Sequence: Synthetic oligonucleotide
uugcugugcuugggccucuc

SEQ ID NO: 1036 - RNA, 20 nt, Artificial Sequence
  Description of Artificial Sequence: Synthetic oligonucleotide
acgucaaaggugaaucgggc

SEQ ID NO: 1037 - RNA, 20 nt, Artificial Sequence
  Description of Artificial Sequence: Synthetic oligonucleotide
cacgucaaaggugaaucggg

SEQ ID NO: 1038 - RNA, 20 nt, Artificial Sequence
  Description of Artificial Sequence: Synthetic oligonucleotide
acacgucaaaggugaaucgg

SEQ ID NO: 1039 - RNA, 20 nt, Artificial Sequence
  Description of Artificial Sequence: Synthetic oligonucleotide
uacacgucaaaggugaaucg

SEQ ID NO: 1040 - RNA, 20 nt, Artificial Sequence
  Description of Artificial Sequence: Synthetic oligonucleotide
guacacgucaaaggugaauc

SEQ ID NO: 1041 - RNA, 20 nt, Artificial Sequence
  Description of Artificial Sequence: Synthetic oligonucleotide
ggcugccaaagaggucucga

SEQ ID NO: 1042 - RNA, 20 nt, Artificial Sequence
  Description of Artificial Sequence: Synthetic oligonucleotide
ucaggcugccaaagaggucu

SEQ ID NO: 1043 - RNA, 20 nt, Artificial Sequence
  Description of Artificial Sequence: Synthetic oligonucleotide
cauucaggcugccaaagagg

SEQ ID NO: 1044 - RNA, 20 nt, Artificial Sequence
  Description of Artificial Sequence: Synthetic oligonucleotide
gacauucaggcugccaaaga

SEQ ID NO: 1045 - RNA, 20 nt, Artificial Sequence
  Description of Artificial Sequence: Synthetic oligonucleotide
ugacauucaggcugccaaag

SEQ ID NO: 1046 - RNA, 20 nt, Artificial Sequence
  Description of Artificial Sequence: Synthetic oligonucleotide
cuuugacauucaggcugcca

SEQ ID NO: 1047 - RNA, 20 nt, Artificial Sequence
  Description of Artificial Sequence: Synthetic oligonucleotide
gcuuugacauucaggcugcc

SEQ ID NO: 1048 - RNA, 20 nt, Artificial Sequence
  Description of Artificial Sequence: Synthetic oligonucleotide
ccguagaauguggcuuugac

SEQ ID NO: 1049 - RNA, 20 nt, Artificial Sequence
  Description of Artificial Sequence: Synthetic oligonucleotide
gcccguagaauguggcuuug

SEQ ID NO: 1050 - RNA, 20 nt, Artificial Sequence
  Description of Artificial Sequence: Synthetic oligonucleotide
uagagcccguagaauguggc

SEQ ID NO: 1051 - RNA, 20 nt, Artificial Sequence
  Description of Artificial Sequence: Synthetic oligonucleotide
guagagcccguagaaugugg

SEQ ID NO: 1052 - RNA, 20 nt, Artificial Sequence
  Description of Artificial Sequence: Synthetic oligonucleotide
aguagagcccguagaaugug

SEQ ID NO: 1053 - RNA, 20 nt, Artificial Sequence
  Description of Artificial Sequence: Synthetic oligonucleotide
agaguagagcccguagaaug

SEQ ID NO: 1054 - RNA, 20 nt, Artificial Sequence
  Description of Artificial Sequence: Synthetic oligonucleotide
uagaguagagcccguagaau

SEQ ID NO: 1055 - RNA, 20 nt, Artificial Sequence
  Description of Artificial Sequence: Synthetic oligonucleotide
auagaguagagcccguagaa

SEQ ID NO: 1056 - RNA, 20 nt, Artificial Sequence
  Description of Artificial Sequence: Synthetic oligonucleotide
cauagaguagagcccguaga

SEQ ID NO: 1057 - RNA, 20 nt, Artificial Sequence
  Description of Artificial Sequence: Synthetic oligonucleotide
ucauagaguagagcccguag

SEQ ID NO: 1058 - RNA, 20 nt, Artificial Sequence
  Description of Artificial Sequence: Synthetic oligonucleotide
cucauagaguagagcccgua

SEQ ID NO: 1059 - RNA, 20 nt, Artificial Sequence
  Description of Artificial Sequence: Synthetic oligonucleotide
gaaagucacaacucauagag

SEQ ID NO: 1060 - RNA, 20 nt, Artificial Sequence
  Description of Artificial Sequence: Synthetic oligonucleotide
ccuugaaagucacaacucau

SEQ ID NO: 1061 - RNA, 20 nt, Artificial Sequence
  Description of Artificial Sequence: Synthetic oligonucleotide
aaguccuugaaagucacaac

SEQ ID NO: 1062 - RNA, 20 nt, Artificial Sequence
  Description of Artificial Sequence: Synthetic oligonucleotide
ccaaguccuugaaagucaca

SEQ ID NO: 1063 - RNA, 20 nt, Artificial Sequence
  Description of Artificial Sequence: Synthetic oligonucleotide
uucuuugggccaaguccuug

SEQ ID NO: 1064 - RNA, 20 nt, Artificial Sequence
  Description of Artificial Sequence: Synthetic oligonucleotide
uuucuuugggccaaguccuu

SEQ ID NO: 1065 - RNA, 20 nt, Artificial Sequence
  Description of Artificial Sequence: Synthetic oligonucleotide
uugauuucugaccugaguac

SEQ ID NO: 1066 - RNA, 20 nt, Artificial Sequence
  Description of Artificial Sequence: Synthetic oligonucleotide
guugauuucugaccugagua

SEQ ID NO: 1067 - RNA, 20 nt, Artificial Sequence
  Description of Artificial Sequence: Synthetic oligonucleotide
gggacuauccaacuguaggg

SEQ ID NO: 1068 - RNA, 20 nt, Artificial Sequence
  Description of Artificial Sequence: Synthetic oligonucleotide
gcaagaggacgaauuauggg

SEQ ID NO: 1069 - RNA, 20 nt, Artificial Sequence
  Description of Artificial Sequence: Synthetic oligonucleotide
ugcaagaggacgaauuaugg

SEQ ID NO: 1070 - RNA, 20 nt, Artificial Sequence
  Description of Artificial Sequence: Synthetic oligonucleotide
gugcaagaggacgaauuaug

SEQ ID NO: 1071 - RNA, 20 nt, Artificial Sequence
  Description of Artificial Sequence: Synthetic oligonucleotide
ggugcaagaggacgaauuau

SEQ ID NO: 1072 - RNA, 20 nt, Artificial Sequence
  Description of Artificial Sequence: Synthetic oligonucleotide
gggugcaagaggacgaauua

SEQ ID NO: 1073 - RNA, 20 nt, Artificial Sequence
  Description of Artificial Sequence: Synthetic oligonucleotide
ugggugcaagaggacgaauu

SEQ ID NO: 1074 - RNA, 20 nt, Artificial Sequence
  Description of Artificial Sequence: Synthetic oligonucleotide
gugggugcaagaggacgaau

SEQ ID NO: 1075 - RNA, 20 nt, Artificial Sequence
  Description of Artificial Sequence: Synthetic oligonucleotide
ggugggugcaagaggacgaa

SEQ ID NO: 1076 - RNA, 20 nt, Artificial Sequence
  Description of Artificial Sequence: Synthetic oligonucleotide
uaggugggugcaagaggacg

SEQ ID NO: 1077 - RNA, 20 nt, Artificial Sequence
  Description of Artificial Sequence: Synthetic oligonucleotide
guaggugggugcaagaggac

SEQ ID NO: 1078 - RNA, 20 nt, Artificial Sequence
  Description of Artificial Sequence: Synthetic oligonucleotide
gguaggugggugcaagagga

SEQ ID NO: 1079 - RNA, 20 nt, Artificial Sequence
  Description of Artificial Sequence: Synthetic oligonucleotide
ccacaagcaagagcuaacua

SEQ ID NO: 1080 - RNA, 20 nt, Artificial Sequence
  Description of Artificial Sequence: Synthetic oligonucleotide
acuuuccacaagcaagagcu

SEQ ID NO: 1081 - RNA, 20 nt, Artificial Sequence
  Description of Artificial Sequence: Synthetic oligonucleotide
gacuuuccacaagcaagagc

SEQ ID NO: 1082 - RNA, 20 nt, Artificial Sequence
  Description of Artificial Sequence: Synthetic oligonucleotide
ggacuuuccacaagcaagag

SEQ ID NO: 1083 - RNA, 20 nt, Artificial Sequence
  Description of Artificial Sequence: Synthetic oligonucleotide
aggacuuuccacaagcaaga

SEQ ID NO: 1084 - RNA, 20 nt, Artificial Sequence
  Description of Artificial Sequence: Synthetic oligonucleotide
gaggacuuuccacaagcaag

SEQ ID NO: 1085 - RNA, 20 nt, Artificial Sequence
  Description of Artificial Sequence: Synthetic oligonucleotide
ugaggacuuuccacaagcaa

SEQ ID NO: 1086 - RNA, 20 nt, Artificial Sequence
  Description of Artificial Sequence: Synthetic oligonucleotide
augaggacuuuccacaagca

SEQ ID NO: 1087 - RNA, 20 nt, Artificial Sequence
  Description of Artificial Sequence: Synthetic oligonucleotide
gaugaggacuuuccacaagc

SEQ ID NO: 1088 - RNA, 20 nt, Artificial Sequence
  Description of Artificial Sequence: Synthetic oligonucleotide
agaugaggacuuuccacaag

SEQ ID NO: 1089 - RNA, 20 nt, Artificial Sequence
  Description of Artificial Sequence: Synthetic oligonucleotide
gagaugaggacuuuccacaa

SEQ ID NO: 1090 - RNA, 20 nt, Artificial Sequence
  Description of Artificial Sequence: Synthetic oligonucleotide
ggagaugaggacuuuccaca

SEQ ID NO: 1091 - RNA, 20 nt, Artificial Sequence
  Description of Artificial Sequence: Synthetic oligonucleotide
ugggagaugaggacuuucca

SEQ ID NO: 1092 - RNA, 20 nt, Artificial Sequence
  Description of Artificial Sequence: Synthetic oligonucleotide
gcugggagaugaggacuuuc

SEQ ID NO: 1093 - RNA, 20 nt, Artificial Sequence
  Description of Artificial Sequence: Synthetic oligonucleotide
ucaagcugggagaugaggac

SEQ ID NO: 1094 - RNA, 20 nt, Artificial Sequence
  Description of Artificial Sequence: Synthetic oligonucleotide
aagccaucaagcugggagau

SEQ ID NO: 1095 - RNA, 20 nt, Artificial Sequence
  Description of Artificial Sequence: Synthetic oligonucleotide
gaagccaucaagcugggaga

SEQ ID NO: 1096 - RNA, 20 nt, Artificial Sequence
  Description of Artificial Sequence: Synthetic oligonucleotide
ggaggaagccaucaagcugg

SEQ ID NO: 1097 - RNA, 20 nt, Artificial Sequence
  Description of Artificial Sequence: Synthetic oligonucleotide
gggaggaagccaucaagcug

SEQ ID NO: 1098 - RNA, 20 nt, Artificial Sequence
  Description of Artificial Sequence: Synthetic oligonucleotide
aacuugggaggaagccauca

SEQ ID NO: 1099 - RNA, 20 nt, Artificial Sequence
  Description of Artificial Sequence: Synthetic oligonucleotide
aaacuugggaggaagccauc

SEQ ID NO: 1100 - RNA, 20 nt, Artificial Sequence
  Description of Artificial Sequence: Synthetic oligonucleotide
cagcaguguggagguccaac

SEQ ID NO: 1101 - RNA, 20 nt, Artificial Sequence
  Description of Artificial Sequence: Synthetic oligonucleotide
gcagcaguguggagguccaa

SEQ ID NO: 1102 - RNA, 20 nt, Artificial Sequence
  Description of Artificial Sequence: Synthetic oligonucleotide
ugcagcaguguggaggucca

SEQ ID NO: 1103 - RNA, 20 nt, Artificial Sequence
  Description of Artificial Sequence: Synthetic oligonucleotide
uugcagcaguguggaggucc

SEQ ID NO: 1104 - RNA, 20 nt, Artificial Sequence
  Description of Artificial Sequence: Synthetic oligonucleotide
gguggaggaaauucccagca

SEQ ID NO: 1105 - RNA, 20 nt, Artificial Sequence
  Description of Artificial Sequence: Synthetic oligonucleotide
acgaaggguggaggaaauuc

SEQ ID NO: 1106 - RNA, 20 nt, Artificial Sequence
  Description of Artificial Sequence: Synthetic oligonucleotide
gacgaaggguggaggaaauu

SEQ ID NO: 1107 - RNA, 20 nt, Artificial Sequence
  Description of Artificial Sequence: Synthetic oligonucleotide
augacgaaggguggaggaaa

SEQ ID NO: 1108 - RNA, 20 nt, Artificial Sequence
  Description of Artificial Sequence: Synthetic oligonucleotide
caugacgaaggguggaggaa

SEQ ID NO: 1109 - RNA, 20 nt, Artificial Sequence
  Description of Artificial Sequence: Synthetic oligonucleotide
gcaugacgaaggguggagga

SEQ ID NO: 1110 - RNA, 20 nt, Artificial Sequence
  Description of Artificial Sequence: Synthetic oligonucleotide
ugcaugacgaaggguggagg

SEQ ID NO: 1111 - RNA, 20 nt, Artificial Sequence
  Description of Artificial Sequence: Synthetic oligonucleotide
cugcaugacgaaggguggag

SEQ ID NO: 1112 - RNA, 20 nt, Artificial Sequence
  Description of Artificial Sequence: Synthetic oligonucleotide
acugcaugacgaagggugga

SEQ ID NO: 1113 - RNA, 20 nt, Artificial Sequence
  Description of Artificial Sequence: Synthetic oligonucleotide
cacugcaugacgaagggugg

SEQ ID NO: 1114 - RNA, 20 nt, Artificial Sequence
  Description of Artificial Sequence: Synthetic oligonucleotide
ccacugcaugacgaagggug

SEQ ID NO: 1115 - RNA, 20 nt, Artificial Sequence
  Description of Artificial Sequence: Synthetic oligonucleotide
uccacugcaugacgaagggu

SEQ ID NO: 1116 - RNA, 20 nt, Artificial Sequence
  Description of Artificial Sequence: Synthetic oligonucleotide
cuccacugcaugacgaaggg

SEQ ID NO: 1117 - RNA, 20 nt, Artificial Sequence
  Description of Artificial Sequence: Synthetic oligonucleotide
ccuccacugcaugacgaagg

SEQ ID NO: 1118 - RNA, 20 nt, Artificial Sequence
  Description of Artificial Sequence: Synthetic oligonucleotide
cccuccacugcaugacgaag

SEQ ID NO: 1119 - RNA, 20 nt, Artificial Sequence
  Description of Artificial Sequence: Synthetic oligonucleotide
cuuaguaggaauggaggcgg

SEQ ID NO: 1120 - RNA, 20 nt, Artificial Sequence
  Description of Artificial Sequence: Synthetic oligonucleotide
ccuuaguaggaauggaggcg

SEQ ID NO: 1121 - RNA, 20 nt, Artificial Sequence
  Description of Artificial Sequence: Synthetic oligonucleotide
cccuuaguaggaauggaggc

SEQ ID NO: 1122 - RNA, 20 nt, Artificial Sequence
  Description of Artificial Sequence: Synthetic oligonucleotide
ucgguuggaaugauucuggg

SEQ ID NO: 1123 - RNA, 20 nt, Artificial Sequence
  Description of Artificial Sequence: Synthetic oligonucleotide
gucgguuggaaugauucugg

SEQ ID NO: 1124 - RNA, 20 nt, Artificial Sequence
  Description of Artificial Sequence: Synthetic oligonucleotide
ggucgguuggaaugauucug

SEQ ID NO: 1125 - RNA, 20 nt, Artificial Sequence
  Description of Artificial Sequence: Synthetic oligonucleotide
gggucgguuggaaugauucu

SEQ ID NO: 1126 - RNA, 20 nt, Artificial Sequence
  Description of Artificial Sequence: Synthetic oligonucleotide
ugggucgguuggaaugauuc

SEQ ID NO: 1127 - RNA, 20 nt, Artificial Sequence
  Description of Artificial Sequence: Synthetic oligonucleotide
gugggucgguuggaaugauu

SEQ ID NO: 1128 - RNA, 20 nt, Artificial Sequence
  Description of Artificial Sequence: Synthetic oligonucleotide
agugggucgguuggaaugau

SEQ ID NO: 1129 - RNA, 20 nt, Artificial Sequence
  Description of Artificial Sequence: Synthetic oligonucleotide
cagugggucgguuggaauga

SEQ ID NO: 1130 - RNA, 20 nt, Artificial Sequence
  Description of Artificial Sequence: Synthetic oligonucleotide
gcagugggucgguuggaaug

SEQ ID NO: 1131 - RNA, 20 nt, Artificial Sequence
  Description of Artificial Sequence: Synthetic oligonucleotide
ugcagugggucgguuggaau

SEQ ID NO: 1132 - RNA, 20 nt, Artificial Sequence
  Description of Artificial Sequence: Synthetic oligonucleotide
uugcagugggucgguuggaa

SEQ ID NO: 1133 - RNA, 20 nt, Artificial Sequence
  Description of Artificial Sequence: Synthetic oligonucleotide
uuugcagugggucgguugga

SEQ ID NO: 1134 - RNA, 20 nt, Artificial Sequence
  Description of Artificial Sequence: Synthetic oligonucleotide
cuuugcagugggucgguugg

SEQ ID NO: 1135 - RNA, 20 nt, Artificial Sequence
  Description of Artificial Sequence: Synthetic oligonucleotide
ucuuugcagugggucgguug

SEQ ID NO: 1136 - RNA, 20 nt, Artificial Sequence
  Description of Artificial Sequence: Synthetic oligonucleotide
uagucuuugcagugggucgg

SEQ ID NO: 1137 - RNA, 20 nt, Artificial Sequence
  Description of Artificial Sequence: Synthetic oligonucleotide
auagucuuugcagugggucg

SEQ ID NO: 1138 - RNA, 20 nt, Artificial Sequence
  Description of Artificial Sequence: Synthetic oligonucleotide
cugucauagucuuugcagug

SEQ ID NO: 1139 - RNA, 20 nt, Artificial Sequence
  Description of Artificial Sequence: Synthetic oligonucleotide
ugcugucauagucuuugcag

SEQ ID NO: 1140 - RNA, 20 nt, Artificial Sequence
  Description of Artificial Sequence: Synthetic oligonucleotide
ucuagccuguacugucugca

SEQ ID NO: 1141 - RNA, 20 nt, Artificial Sequence
  Description of Artificial Sequence: Synthetic oligonucleotide
aucuagccuguacugucugc

SEQ ID NO: 1142 - RNA, 20 nt, Artificial Sequence
  Description of Artificial Sequence: Synthetic oligonucleotide
uaucuagccuguacugucug

SEQ ID NO: 1143 - RNA, 20 nt, Artificial Sequence
  Description of Artificial Sequence: Synthetic oligonucleotide
uuaucuagccuguacugucu

SEQ ID NO: 1144 - RNA, 20 nt, Artificial Sequence
  Description of Artificial Sequence: Synthetic oligonucleotide
guuaucuagccuguacuguc

SEQ ID NO: 1145 - RNA, 20 nt, Artificial Sequence
  Description of Artificial Sequence: Synthetic oligonucleotide
gguuaucuagccuguacugu

SEQ ID NO: 1146 - RNA, 20 nt, Artificial Sequence
  Description of Artificial Sequence: Synthetic oligonucleotide
ggguuaucuagccuguacug

SEQ ID NO: 1147 - RNA, 20 nt, Artificial Sequence
  Description of Artificial Sequence: Synthetic oligonucleotide
uggguuaucuagccuguacu

SEQ ID NO: 1148 - RNA, 20 nt, Artificial Sequence
  Description of Artificial Sequence: Synthetic oligonucleotide
guggguuaucuagccuguac

SEQ ID NO: 1149 - RNA, 20 nt, Artificial Sequence
  Description of Artificial Sequence: Synthetic oligonucleotide
gguggguuaucuagccugua

SEQ ID NO: 1150 - RNA, 20 nt, Artificial Sequence
  Description of Artificial Sequence: Synthetic oligonucleotide
ggguggguuaucuagccugu

SEQ ID NO: 1151 - RNA, 20 nt, Artificial Sequence
  Description of Artificial Sequence: Synthetic oligonucleotide
uggguggguuaucuagccug

SEQ ID NO: 1152 - RNA, 20 nt, Artificial Sequence
  Description of Artificial Sequence: Synthetic oligonucleotide
uuggguggguuaucuagccu

SEQ ID NO: 1153 - RNA, 20 nt, Artificial Sequence
  Description of Artificial Sequence: Synthetic oligonucleotide
auuggguggguuaucuagcc

SEQ ID NO: 1154 - RNA, 20 nt, Artificial Sequence
  Description of Artificial Sequence: Synthetic oligonucleotide
aauuggguggguuaucuagc

SEQ ID NO: 1155 - RNA, 20 nt, Artificial Sequence
  Description of Artificial Sequence: Synthetic oligonucleotide
aaauuggguggguuaucuag

SEQ ID NO: 1156 - RNA, 20 nt, Artificial Sequence
  Description of Artificial Sequence: Synthetic oligonucleotide
ggaaauuggguggguuaucu

SEQ ID NO: 1157 - RNA, 20 nt, Artificial Sequence
  Description of Artificial Sequence: Synthetic oligonucleotide
gggaaauuggguggguuauc

SEQ ID NO: 1158 - RNA, 20 nt, Artificial Sequence
  Description of Artificial Sequence: Synthetic oligonucleotide
gaaagguucugucacgaggg

SEQ ID NO: 1159 - RNA, 20 nt, Artificial Sequence
  Description of Artificial Sequence: Synthetic oligonucleotide
gcugaaagguucugucacga

SEQ ID NO: 1160 - RNA, 20 nt, Artificial Sequence
  Description of Artificial Sequence: Synthetic oligonucleotide
ugcugaaagguucugucacg

SEQ ID NO: 1161 - RNA, 20 nt, Artificial Sequence
  Description of Artificial Sequence: Synthetic oligonucleotide
ggcguuaugcugaaagguuc

SEQ ID NO: 1162 - RNA, 20 nt, Artificial Sequence
  Description of Artificial Sequence: Synthetic oligonucleotide
aggcguuaugcugaaagguu

SEQ ID NO: 1163 - RNA, 20 nt, Artificial Sequence
  Description of Artificial Sequence: Synthetic oligonucleotide
gaggcguuaugcugaaaggu

SEQ ID NO: 1164 - RNA, 20 nt, Artificial Sequence
  Description of Artificial Sequence: Synthetic oligonucleotide
ugaggcguuaugcugaaagg

SEQ ID NO: 1165 - RNA, 20 nt, Artificial Sequence
  Description of Artificial Sequence: Synthetic oligonucleotide
gugaggcguuaugcugaaag

SEQ ID NO: 1166 - RNA, 20 nt, Artificial Sequence
  Description of Artificial Sequence: Synthetic oligonucleotide
augugaggcguuaugcugaa

SEQ ID NO: 1167 - RNA, 20 nt, Artificial Sequence
  Description of Artificial Sequence: Synthetic oligonucleotide
gaugugaggcguuaugcuga

SEQ ID NO: 1168 - RNA, 20 nt, Artificial Sequence
  Description of Artificial Sequence: Synthetic oligonucleotide
ggaugugaggcguuaugcug

SEQ ID NO: 1169 - RNA, 20 nt, Artificial Sequence
  Description of Artificial Sequence: Synthetic oligonucleotide
gggaugugaggcguuaugcu

SEQ ID NO: 1170 - RNA, 20 nt, Artificial Sequence
  Description of Artificial Sequence: Synthetic oligonucleotide
cuugggaugugaggcguuau

SEQ ID NO: 1171 - RNA, 20 nt, Artificial Sequence
  Description of Artificial Sequence: Synthetic oligonucleotide
agacuugggaugugaggcgu

SEQ ID NO: 1172 - RNA, 20 nt, Artificial Sequence
  Description of Artificial Sequence: Synthetic oligonucleotide
uagacuugggaugugaggcg

SEQ ID NO: 1173 - RNA, 20 nt, Artificial Sequence
  Description of Artificial Sequence: Synthetic oligonucleotide
auagacuugggaugugaggc

SEQ ID NO: 1174 - RNA, 20 nt, Artificial Sequence
  Description of Artificial Sequence: Synthetic oligonucleotide
uauagacuugggaugugagg

SEQ ID NO: 1175 - RNA, 20 nt, Artificial Sequence
  Description of Artificial Sequence: Synthetic oligonucleotide
ggguauagacuugggaugug

SEQ ID NO: 1176 - RNA, 20 nt, Artificial Sequence
  Description of Artificial Sequence: Synthetic oligonucleotide
aggguauagacuugggaugu

SEQ ID NO: 1177 - RNA, 20 nt, Artificial Sequence
  Description of Artificial Sequence: Synthetic oligonucleotide
aagguggcuaggaaagaaca

SEQ ID NO: 1178 - RNA, 20 nt, Artificial Sequence
  Description of Artificial Sequence: Synthetic oligonucleotide
aaagguggcuaggaaagaac

SEQ ID NO: 1179 - RNA, 20 nt, Artificial Sequence
  Description of Artificial Sequence: Synthetic oligonucleotide
gaaagguggcuaggaaagaa

SEQ ID NO: 1180 - RNA, 20 nt, Artificial Sequence
  Description of Artificial Sequence: Synthetic oligonucleotide
acaucuugaucuuggccuuu

SEQ ID NO: 1181 - RNA, 20 nt, Artificial Sequence
  Description of Artificial Sequence: Synthetic oligonucleotide
ggcugggaucaagaugccug

SEQ ID NO: 1182 - RNA, 20 nt, Artificial Sequence
  Description of Artificial Sequence: Synthetic oligonucleotide
gucaggcugggaucaagaug

SEQ ID NO: 1183 - RNA, 20 nt, Artificial Sequence
  Description of Artificial Sequence: Synthetic oligonucleotide
agucaggcugggaucaagau

SEQ ID NO: 1184 - RNA, 20 nt, Artificial Sequence
  Description of Artificial Sequence: Synthetic oligonucleotide
cagucaggcugggaucaaga

SEQ ID NO: 1185 - RNA, 20 nt, Artificial Sequence
  Description of Artificial Sequence: Synthetic oligonucleotide
agcagucaggcugggaucaa

SEQ ID NO: 1186 - RNA, 20 nt, Artificial Sequence
  Description of Artificial Sequence: Synthetic oligonucleotide
gauguagcagcagucaggcu

SEQ ID NO: 1187 - RNA, 20 nt, Artificial Sequence
  Description of Artificial Sequence: Synthetic oligonucleotide
ggauuagauguagcagcagu

SEQ ID NO: 1188 - RNA, 20 nt, Artificial Sequence
  Description of Artificial Sequence: Synthetic oligonucleotide
gggauuagauguagcagcag

SEQ ID NO: 1189 - RNA, 20 nt, Artificial Sequence
  Description of Artificial Sequence: Synthetic oligonucleotide
gacaggaggcauugguaggg

SEQ ID NO: 1190 - RNA, 20 nt, Artificial Sequence
  Description of Artificial Sequence: Synthetic oligonucleotide
uuagggacaggaggcauugg

SEQ ID NO: 1191 - RNA, 20 nt, Artificial Sequence
  Description of Artificial Sequence: Synthetic oligonucleotide
uuuagggacaggaggcauug

SEQ ID NO: 1192 - RNA, 20 nt, Artificial Sequence
  Description of Artificial Sequence: Synthetic oligonucleotide
gaguuuagggacaggaggca

SEQ ID NO: 1193 - RNA, 20 nt, Artificial Sequence
  Description of Artificial Sequence: Synthetic oligonucleotide
ggaguuuagggacaggaggc

SEQ ID NO: 1194 - RNA, 20 nt, Artificial Sequence
  Description of Artificial Sequence: Synthetic oligonucleotide
gcugucaucaguaugcuggg

SEQ ID NO: 1195 - RNA, 20 nt, Artificial Sequence
  Description of Artificial Sequence: Synthetic oligonucleotide
ggcugucaucaguaugcugg

SEQ ID NO: 1196 - RNA, 20 nt, Artificial Sequence
  Description of Artificial Sequence: Synthetic oligonucleotide
gggcugucaucaguaugcug

SEQ ID NO: 1197 - RNA, 20 nt, Artificial Sequence
  Description of Artificial Sequence: Synthetic oligonucleotide
agggcugucaucaguaugcu

SEQ ID NO: 1198 - RNA, 20 nt, Artificial Sequence
  Description of Artificial Sequence: Synthetic oligonucleotide
agagagggcugucaucagua

SEQ ID NO: 1199 - RNA, 20 nt, Artificial Sequence
  Description of Artificial Sequence: Synthetic oligonucleotide
cagagagggcugucaucagu

SEQ ID NO: 1200 - RNA, 20 nt, Artificial Sequence
  Description of Artificial Sequence: Synthetic oligonucleotide
ucagagagggcugucaucag

SEQ ID NO: 1201 - RNA, 20 nt, Artificial Sequence
  Description of Artificial Sequence: Synthetic oligonucleotide
gucagagagggcugucauca

SEQ ID NO: 1202 - RNA, 20 nt, Artificial Sequence
  Description of Artificial Sequence: Synthetic oligonucleotide
gguaaagucagagagggcug

SEQ ID NO: 1203 - RNA, 20 nt, Artificial Sequence
  Description of Artificial Sequence: Synthetic oligonucleotide
gggaaggguaugaagacaga

SEQ ID NO: 1204 - RNA, 20 nt, Artificial Sequence
  Description of Artificial Sequence: Synthetic oligonucleotide
uugccuucggcuugcucugg

SEQ ID NO: 1205 - RNA, 20 nt, Artificial Sequence
  Description of Artificial Sequence: Synthetic oligonucleotide
cuugccuucggcuugcucug

SEQ ID NO: 1206 - RNA, 20 nt, Artificial Sequence
  Description of Artificial Sequence: Synthetic oligonucleotide
gcuugccuucggcuugcucu

SEQ ID NO: 1207 - RNA, 20 nt, Artificial Sequence
  Description of Artificial Sequence: Synthetic oligonucleotide
ugcuugccuucggcuugcuc

SEQ ID NO: 1208 - RNA, 20 nt, Artificial Sequence
  Description of Artificial Sequence: Synthetic oligonucleotide
gugcuugccuucggcuugcu

SEQ ID NO: 1209 - RNA, 20 nt, Artificial Sequence
  Description of Artificial Sequence: Synthetic oligonucleotide
ucgugcuugccuucggcuug

SEQ ID NO: 1210 - RNA, 20 nt, Artificial Sequence
  Description of Artificial Sequence: Synthetic oligonucleotide
aucgugcuugccuucggcuu

SEQ ID NO: 1211 - RNA, 20 nt, Artificial Sequence
  Description of Artificial Sequence: Synthetic oligonucleotide
caucgugcuugccuucggcu

SEQ ID NO: 1212 - RNA, 20 nt, Artificial Sequence
  Description of Artificial Sequence: Synthetic oligonucleotide
agcgccaucgugcuugccuu

SEQ ID NO: 1213 - RNA, 20 nt, Artificial Sequence
  Description of Artificial Sequence: Synthetic oligonucleotide
uggugagcgccaucgugcuu

SEQ ID NO: 1214 - RNA, 20 nt, Artificial Sequence
  Description of Artificial Sequence: Synthetic oligonucleotide
cugaugcucggcugcuacag

SEQ ID NO: 1215 - RNA, 20 nt, Artificial Sequence
  Description of Artificial Sequence: Synthetic oligonucleotide
gcugaugcucggcugcuaca

SEQ ID NO: 1216 - RNA, 20 nt, Artificial Sequence
  Description of Artificial Sequence: Synthetic oligonucleotide
uuucgggcugaugcucggcu

SEQ ID NO: 1217 - RNA, 20 nt, Artificial Sequence
  Description of Artificial Sequence: Synthetic oligonucleotide
uccuuucgggcugaugcucg

SEQ ID NO: 1218 - RNA, 20 nt, Artificial Sequence
  Description of Artificial Sequence: Synthetic oligonucleotide
uuccuuucgggcugaugcuc

SEQ ID NO: 1219 - RNA, 20 nt, Artificial Sequence
  Description of Artificial Sequence: Synthetic oligonucleotide
cuuccuuucgggcugaugcu

SEQ ID NO: 1220 - RNA, 20 nt, Artificial Sequence
  Description of Artificial Sequence: Synthetic oligonucleotide
gcuuccuuucgggcugaugc

SEQ ID NO: 1221 - RNA, 20 nt, Artificial Sequence
  Description of Artificial Sequence: Synthetic oligonucleotide
ugcuuccuuucgggcugaug

SEQ ID NO: 1222 - RNA, 20 nt, Artificial Sequence
  Description of Artificial Sequence: Synthetic oligonucleotide
gugcuuccuuucgggcugau

SEQ ID NO: 1223 - RNA, 20 nt, Artificial Sequence
  Description of Artificial Sequence: Synthetic oligonucleotide
cgugcuuccuuucgggcuga

SEQ ID NO: 1224 - RNA, 20 nt, Artificial Sequence
  Description of Artificial Sequence: Synthetic oligonucleotide
ucgugcuuccuuucgggcug

SEQ ID NO: 1225 - RNA, 20 nt, Artificial Sequence
  Description of Artificial Sequence: Synthetic oligonucleotide
uucgugcuuccuuucgggcu

SEQ ID NO: 1226 - RNA, 20 nt, Artificial Sequence
  Description of Artificial Sequence: Synthetic oligonucleotide
uuucgugcuuccuuucgggc

SEQ ID NO: 1227 - RNA, 20 nt, Artificial Sequence
  Description of Artificial Sequence: Synthetic oligonucleotide
cuuucgugcuuccuuucggg

SEQ ID NO: 1228 - RNA, 20 nt, Artificial Sequence
  Description of Artificial Sequence: Synthetic oligonucleotide
gcuuucgugcuuccuuucgg

SEQ ID NO: 1229 - RNA, 20 nt, Artificial Sequence
  Description of Artificial Sequence: Synthetic oligonucleotide
auguacgccagcgugcugcu

SEQ ID NO: 1230 - RNA, 20 nt, Artificial Sequence
  Description of Artificial Sequence: Synthetic oligonucleotide
ucagcauguacgccagcgug

SEQ ID NO: 1231 - RNA, 20 nt, Artificial Sequence
  Description of Artificial Sequence: Synthetic oligonucleotide
aggcgguguacuacgugugc

SEQ ID NO: 1232 - RNA, 20 nt, Artificial Sequence
  Description of Artificial Sequence: Synthetic oligonucleotide
aaggcgguguacuacgugug

SEQ ID NO: 1233 - RNA, 20 nt, Artificial Sequence
  Description of Artificial Sequence: Synthetic oligonucleotide
caaggcgguguacuacgugu

SEQ ID NO: 1234 - RNA, 20 nt, Artificial Sequence
  Description of Artificial Sequence: Synthetic oligonucleotide
gcaaggcgguguacuacgug

SEQ ID NO: 1235 - RNA, 20 nt, Artificial Sequence
  Description of Artificial Sequence: Synthetic oligonucleotide
ugcaaggcgguguacuacgu

SEQ ID NO: 1236 - RNA, 20 nt, Artificial Sequence
  Description of Artificial Sequence: Synthetic oligonucleotide
cugcaaggcgguguacuacg

SEQ ID NO: 1237 - RNA, 20 nt, Artificial Sequence
  Description of Artificial Sequence: Synthetic oligonucleotide
gcugcaaggcgguguacuac

SEQ ID NO: 1238 - RNA, 20 nt, Artificial Sequence
  Description of Artificial Sequence: Synthetic oligonucleotide
ggcugcaaggcgguguacua

SEQ ID NO: 1239 - RNA, 20 nt, Artificial Sequence
  Description of Artificial Sequence: Synthetic oligonucleotide
gcucuuuguggccuuccuga

SEQ ID NO: 1240 - RNA, 20 nt, Artificial Sequence
  Description of Artificial Sequence: Synthetic oligonucleotide
cgcucuuuguggccuuccug

SEQ ID NO: 1241 - RNA, 20 nt, Artificial Sequence
  Description of Artificial Sequence: Synthetic oligonucleotide
cuucgugguguggagcuugg

SEQ ID NO: 1242 - RNA, 20 nt, Artificial Sequence
  Description of Artificial Sequence: Synthetic oligonucleotide
ggcuucgugguguggagcuu

SEQ ID NO: 1243 - RNA, 20 nt, Artificial Sequence
  Description of Artificial Sequence: Synthetic oligonucleotide
caacggcuucguggugugga

SEQ ID NO: 1244 - RNA, 20 nt, Artificial Sequence
  Description of Artificial Sequence: Synthetic oligonucleotide
uggcaacggcuucguggugu

SEQ ID NO: 1245 - RNA, 20 nt, Artificial Sequence
  Description of Artificial Sequence: Synthetic oligonucleotide
ugagcuggaagacuucgcgg

SEQ ID NO: 1246 - RNA, 20 nt, Artificial Sequence
  Description of Artificial Sequence: Synthetic oligonucleotide
cugagcuggaagacuucgcg

SEQ ID NO: 1247 - RNA, 20 nt, Artificial Sequence
  Description of Artificial Sequence: Synthetic oligonucleotide
gcugagcuggaagacuucgc

SEQ ID NO: 1248 - RNA, 20 nt, Artificial Sequence
  Description of Artificial Sequence: Synthetic oligonucleotide
acacugcugagcuggaagac

SEQ ID NO: 1249 - RNA, 20 nt, Artificial Sequence
  Description of Artificial Sequence: Synthetic oligonucleotide
cgagacacugcugagcugga

SEQ ID NO: 1250 - RNA, 20 nt, Artificial Sequence
  Description of Artificial Sequence: Synthetic oligonucleotide
acgagacacugcugagcugg

SEQ ID NO: 1251 - RNA, 20 nt, Artificial Sequence
  Description of Artificial Sequence: Synthetic oligonucleotide
aacgagacacugcugagcug

SEQ ID NO: 1252 - RNA, 20 nt, Artificial Sequence
  Description of Artificial Sequence: Synthetic oligonucleotide
gaacgagacacugcugagcu

SEQ ID NO: 1253 - RNA, 20 nt, Artificial Sequence
  Description of Artificial Sequence: Synthetic oligonucleotide
ggaacgagacacugcugagc

SEQ ID NO: 1254 - RNA, 20 nt, Artificial Sequence
  Description of Artificial Sequence: Synthetic oligonucleotide
gggaacgagacacugcugag

SEQ ID NO: 1255 - RNA, 20 nt, Artificial Sequence
  Description of Artificial Sequence: Synthetic oligonucleotide
agggaacgagacacugcuga

SEQ ID NO: 1256 - RNA, 20 nt, Artificial Sequence
  Description of Artificial Sequence: Synthetic oligonucleotide
cagggaacgagacacugcug

SEQ ID NO: 1257 - RNA, 20 nt, Artificial Sequence
  Description of Artificial Sequence: Synthetic oligonucleotide
ccagggaacgagacacugcu

SEQ ID NO: 1258 - RNA, 20 nt, Artificial Sequence
  Description of Artificial Sequence: Synthetic oligonucleotide
aaggaugucggucugcuacc

SEQ ID NO: 1259 - RNA, 20 nt, Artificial Sequence
  Description of Artificial Sequence: Synthetic oligonucleotide
gaaggaugucggucugcuac

SEQ ID NO: 1260 - RNA, 20 nt, Artificial Sequence
  Description of Artificial Sequence: Synthetic oligonucleotide
agaaggaugucggucugcua

SEQ ID NO: 1261 - RNA, 20 nt, Artificial Sequence
  Description of Artificial Sequence: Synthetic oligonucleotide
uaggcccagaaggaugucgg

SEQ ID NO: 1262 - RNA, 20 nt, Artificial Sequence
  Description of Artificial Sequence: Synthetic oligonucleotide
guaggcccagaaggaugucg

SEQ ID NO: 1263 - RNA, 20 nt, Artificial Sequence
  Description of Artificial Sequence: Synthetic oligonucleotide
uguaggcccagaaggauguc

SEQ ID NO: 1264 - RNA, 20 nt, Artificial Sequence
  Description of Artificial Sequence: Synthetic oligonucleotide
cuguaggcccagaaggaugu

SEQ ID NO: 1265 - RNA, 20 nt, Artificial Sequence
  Description of Artificial Sequence: Synthetic oligonucleotide
ccuguaggcccagaaggaug

SEQ ID NO: 1266 - RNA, 20 nt, Artificial Sequence
  Description of Artificial Sequence: Synthetic oligonucleotide
accuguaggcccagaaggau

SEQ ID NO: 1267 - RNA, 20 nt, Artificial Sequence
  Description of Artificial Sequence: Synthetic oligonucleotide
cuucucaucgggcaucacag

SEQ ID NO: 1268 - RNA, 20 nt, Artificial Sequence
  Description of Artificial Sequence: Synthetic oligonucleotide
ccuucucaucgggcaucaca

SEQ ID NO: 1269 - RNA, 20 nt, Artificial Sequence
  Description of Artificial Sequence: Synthetic oligonucleotide
accuucucaucgggcaucac

SEQ ID NO: 1270 - RNA, 20 nt, Artificial Sequence
  Description of Artificial Sequence: Synthetic oligonucleotide
caccuucucaucgggcauca

SEQ ID NO: 1271 - RNA, 20 nt, Artificial Sequence
  Description of Artificial Sequence: Synthetic oligonucleotide
gcaccuucucaucgggcauc

SEQ ID NO: 1272 - RNA, 20 nt, Artificial Sequence
  Description of Artificial Sequence: Synthetic oligonucleotide
ggcaccuucucaucgggcau

SEQ ID NO: 1273 - RNA, 20 nt, Artificial Sequence
  Description of Artificial Sequence: Synthetic oligonucleotide
uggcaccuucucaucgggca

SEQ ID NO: 1274 - RNA, 20 nt, Artificial Sequence
  Description of Artificial Sequence: Synthetic oligonucleotide
auggcaccuucucaucgggc

SEQ ID NO: 1275 - RNA, 20 nt, Artificial Sequence
  Description of Artificial Sequence: Synthetic oligonucleotide
cauggcaccuucucaucggg

SEQ ID NO: 1276 - RNA, 20 nt, Artificial Sequence
  Description of Artificial Sequence: Synthetic oligonucleotide
gcauggcaccuucucaucgg

SEQ ID NO: 1277 - RNA, 20 nt, Artificial Sequence
  Description of Artificial Sequence: Synthetic oligonucleotide
ggcauggcaccuucucaucg

SEQ ID NO: 1278 - RNA, 20 nt, Artificial Sequence
  Description of Artificial Sequence: Synthetic oligonucleotide
gaggcauggcaccuucucau

SEQ ID NO: 1279 - RNA, 20 nt, Artificial Sequence
  Description of Artificial Sequence: Synthetic oligonucleotide
ggaggcauggcaccuucuca

SEQ ID NO: 1280 - RNA, 20 nt, Artificial Sequence
  Description of Artificial Sequence: Synthetic oligonucleotide
gacucccaggcagaaaagag

SEQ ID NO: 1281 - RNA, 20 nt, Artificial Sequence
  Description of Artificial Sequence: Synthetic oligonucleotide
ggacucccaggcagaaaaga

SEQ ID NO: 1282 - RNA, 20 nt, Artificial Sequence
  Description of Artificial Sequence: Synthetic oligonucleotide
aggacucccaggcagaaaag

SEQ ID NO: 1283 - RNA, 20 nt, Artificial Sequence
  Description of Artificial Sequence: Synthetic oligonucleotide
ucaggacucccaggcagaaa

SEQ ID NO: 1284 - RNA, 20 nt, Artificial Sequence
  Description of Artificial Sequence: Synthetic oligonucleotide
gaagucaggacucccaggca

SEQ ID NO: 1285 - RNA, 20 nt, Artificial Sequence
  Description of Artificial Sequence: Synthetic oligonucleotide
guggaagucaggacucccag

SEQ ID NO: 1286 - RNA, 20 nt, Artificial Sequence
  Description of Artificial Sequence: Synthetic oligonucleotide
ucguggaagucaggacuccc

SEQ ID NO: 1287 - RNA, 20 nt, Artificial Sequence
  Description of Artificial Sequence: Synthetic oligonucleotide
cucguggaagucaggacucc

SEQ ID NO: 1288 - RNA, 20 nt, Artificial Sequence
  Description of Artificial Sequence: Synthetic oligonucleotide
ccucguggaagucaggacuc

SEQ ID NO: 1289 - RNA, 20 nt, Artificial Sequence
  Description of Artificial Sequence: Synthetic oligonucleotide
uggguccucguggaagucag

SEQ ID NO: 1290 - RNA, 20 nt, Artificial Sequence
  Description of Artificial Sequence: Synthetic oligonucleotide
cuggguccucguggaaguca

SEQ ID NO: 1291 - RNA, 20 nt, Artificial Sequence
  Description of Artificial Sequence: Synthetic oligonucleotide
ucuggguccucguggaaguc

SEQ ID NO: 1292 - RNA, 20 nt, Artificial Sequence
  Description of Artificial Sequence: Synthetic oligonucleotide
gucuggguccucguggaagu

SEQ ID NO: 1293 - RNA, 20 nt, Artificial Sequence
  Description of Artificial Sequence: Synthetic oligonucleotide
aagaaggaguuguguuugag

SEQ ID NO: 1294 - RNA, 20 nt, Artificial Sequence
  Description of Artificial Sequence: Synthetic oligonucleotide
ccaagaaggaguuguguuug

SEQ ID NO: 1295 - RNA, 20 nt, Artificial Sequence
  Description of Artificial Sequence: Synthetic oligonucleotide
guuccaagaaggaguugugu

SEQ ID NO: 1296 - RNA, 20 nt, Artificial Sequence
  Description of Artificial Sequence: Synthetic oligonucleotide
gguuccaagaaggaguugug

SEQ ID NO: 1297 - RNA, 20 nt, Artificial Sequence
  Description of Artificial Sequence: Synthetic oligonucleotide
caggucaacugacugggagc

SEQ ID NO: 1298 - RNA, 20 nt, Artificial Sequence
  Description of Artificial Sequence: Synthetic oligonucleotide
ugccuguuuaccacugagcu

SEQ ID NO: 1299 - RNA, 20 nt, Artificial Sequence
  Description of Artificial Sequence: Synthetic oligonucleotide
augccuguuuaccacugagc

SEQ ID NO: 1300 - RNA, 20 nt, Artificial Sequence
  Description of Artificial Sequence: Synthetic oligonucleotide
uaugccuguuuaccacugag

SEQ ID NO: 1301 - RNA, 20 nt, Artificial Sequence
  Description of Artificial Sequence: Synthetic oligonucleotide
uuaugccuguuuaccacuga

SEQ ID NO: 1302 - RNA, 20 nt, Artificial Sequence
  Description of Artificial Sequence: Synthetic oligonucleotide
uuuaugccuguuuaccacug

SEQ ID NO: 1303 - RNA, 20 nt, Artificial Sequence
  Description of Artificial Sequence: Synthetic oligonucleotide
cuuuaugccuguuuaccacu

SEQ ID NO: 1304 - RNA, 20 nt, Artificial Sequence
  Description of Artificial Sequence: Synthetic oligonucleotide
acuuuaugccuguuuaccac

SEQ ID NO: 1305 - RNA, 20 nt, Artificial Sequence
  Description of Artificial Sequence: Synthetic oligonucleotide
uagagauagugacagccugg

SEQ ID NO: 1306 - RNA, 20 nt, Artificial Sequence
  Description of Artificial Sequence: Synthetic oligonucleotide
guagagauagugacagccug

SEQ ID NO: 1307 - RNA, 20 nt, Artificial Sequence
  Description of Artificial Sequence: Synthetic oligonucleotide
uggugguagagauagugaca

SEQ ID NO: 1308 - RNA, 20 nt, Artificial Sequence
  Description of Artificial Sequence: Synthetic oligonucleotide
guggugguagagauagugac

SEQ ID NO: 1309 - RNA, 20 nt, Artificial Sequence
  Description of Artificial Sequence: Synthetic oligonucleotide
uagaggaguggugguagaga

SEQ ID NO: 1310 - RNA, 20 nt, Artificial Sequence
  Description of Artificial Sequence: Synthetic oligonucleotide
acuagaggaguggugguaga

SEQ ID NO: 1311 - RNA, 20 nt, Artificial Sequence
  Description of Artificial Sequence: Synthetic oligonucleotide
agacuagaggagugguggua

SEQ ID NO: 1312 - RNA, 20 nt, Artificial Sequence
  Description of Artificial Sequence: Synthetic oligonucleotide
cagacuagaggagugguggu

SEQ ID NO: 1313 - RNA, 20 nt, Artificial Sequence
  Description of Artificial Sequence: Synthetic oligonucleotide
ccagacuagaggaguggugg

SEQ ID NO: 1314 - RNA, 20 nt, Artificial Sequence
  Description of Artificial Sequence: Synthetic oligonucleotide
gccagacuagaggaguggug

SEQ ID NO: 1315 - RNA, 20 nt, Artificial Sequence
  Description of Artificial Sequence: Synthetic oligonucleotide
ggccagacuagaggaguggu

SEQ ID NO: 1316 - RNA, 20 nt, Artificial Sequence
  Description of Artificial Sequence: Synthetic oligonucleotide
gcccagaugugcuagaaugg

SEQ ID NO: 1317 - RNA, 20 nt, Artificial Sequence
  Description of Artificial Sequence: Synthetic oligonucleotide
ugcccagaugugcuagaaug

SEQ ID NO: 1318 - RNA, 20 nt, Artificial Sequence
  Description of Artificial Sequence: Synthetic oligonucleotide
uugcccagaugugcuagaau

SEQ ID NO: 1319 - RNA, 20 nt, Artificial Sequence
  Description of Artificial Sequence: Synthetic oligonucleotide
uuugcccagaugugcuagaa

SEQ ID NO: 1320 - RNA, 20 nt, Artificial Sequence
  Description of Artificial Sequence: Synthetic oligonucleotide
uuuugcccagaugugcuaga

SEQ ID NO: 1321 - RNA, 20 nt, Artificial Sequence
  Description of Artificial Sequence: Synthetic oligonucleotide
ccaguuuugcccagaugugc

SEQ ID NO: 1322 - RNA, 20 nt, Artificial Sequence
  Description of Artificial Sequence: Synthetic oligonucleotide
auccaguuuugcccagaugu

SEQ ID NO: 1323 - RNA, 20 nt, Artificial Sequence
  Description of Artificial Sequence: Synthetic oligonucleotide
ccauccaguuuugcccagau

SEQ ID NO: 1324 - RNA, 20 nt, Artificial Sequence
  Description of Artificial Sequence: Synthetic oligonucleotide
caccauccaguuuugcccag

SEQ ID NO: 1325 - RNA, 20 nt, Artificial Sequence
  Description of Artificial Sequence: Synthetic oligonucleotide
ccaccauccaguuuugccca

SEQ ID NO: 1326 - RNA, 20 nt, Artificial Sequence
  Description of Artificial Sequence: Synthetic oligonucleotide
cccaccauccaguuuugccc

SEQ ID NO: 1327 - RNA, 20 nt, Artificial Sequence
  Description of Artificial Sequence: Synthetic oligonucleotide
uugcucccagcuugguaagu

SEQ ID NO: 1328 - RNA, 20 nt, Artificial Sequence
  Description of Artificial Sequence: Synthetic oligonucleotide
gcuugcucccagcuugguaa

SEQ ID NO: 1329 - RNA, 20 nt, Artificial Sequence
  Description of Artificial Sequence: Synthetic oligonucleotide
auccugcuugcucccagcuu

SEQ ID NO: 1330 - RNA, 20 nt, Artificial Sequence
  Description of Artificial Sequence: Synthetic oligonucleotide
aauccugcuugcucccagcu

SEQ ID NO: 1331 - RNA, 20 nt, Artificial Sequence
  Description of Artificial Sequence: Synthetic oligonucleotide
caauccugcuugcucccagc

SEQ ID NO: 1332 - RNA, 20 nt, Artificial Sequence
  Description of Artificial Sequence: Synthetic oligonucleotide
ccaauccugcuugcucccag

SEQ ID NO: 1333 - RNA, 20 nt, Artificial Sequence
  Description of Artificial Sequence: Synthetic oligonucleotide
aaccuuucagcuucuccagg

SEQ ID NO: 1334 - RNA, 20 nt, Artificial Sequence
  Description of Artificial Sequence: Synthetic oligonucleotide
uaaccuuucagcuucuccag

SEQ ID NO: 1335 - RNA, 20 nt, Artificial Sequence
  Description of Artificial Sequence: Synthetic oligonucleotide
uuaaccuuucagcuucucca

SEQ ID NO: 1336 - RNA, 20 nt, Artificial Sequence
  Description of Artificial Sequence: Synthetic oligonucleotide
acugcugcuuaaccuuucag

SEQ ID NO: 1337 - RNA, 20 nt, Artificial Sequence
  Description of Artificial Sequence: Synthetic oligonucleotide
uacugcugcuuaaccuuuca

SEQ ID NO: 1338 - RNA, 20 nt, Artificial Sequence
  Description of Artificial Sequence: Synthetic oligonucleotide
cuacugcugcuuaaccuuuc

SEQ ID NO: 1339 - RNA, 20 nt, Artificial Sequence
  Description of Artificial Sequence: Synthetic oligonucleotide
ccuacugcugcuuaaccuuu

SEQ ID NO: 1340 - RNA, 20 nt, Artificial Sequence
  Description of Artificial Sequence: Synthetic oligonucleotide
gccuacugcugcuuaaccuu

SEQ ID NO: 1341 - RNA, 20 nt, Artificial Sequence
  Description of Artificial Sequence: Synthetic oligonucleotide
caggacaggaguaggcaccu

SEQ ID NO: 1342 - RNA, 20 nt, Artificial Sequence
  Description of Artificial Sequence: Synthetic oligonucleotide
acaggacaggaguaggcacc

SEQ ID NO: 1343 - RNA, 20 nt, Artificial Sequence
  Description of Artificial Sequence: Synthetic oligonucleotide
gcacaggacaggaguaggca

SEQ ID NO: 1344 - RNA, 20 nt, Artificial Sequence
  Description of Artificial Sequence: Synthetic oligonucleotide
auaggcacaggacaggagua

SEQ ID NO: 1345 - RNA, 20 nt, Artificial Sequence
  Description of Artificial Sequence: Synthetic oligonucleotide
gauaggcacaggacaggagu

SEQ ID NO: 1346 - RNA, 20 nt, Artificial Sequence
  Description of Artificial Sequence: Synthetic oligonucleotide
ugauaggcacaggacaggag

SEQ ID NO: 1347 - RNA, 20 nt, Artificial Sequence
  Description of Artificial Sequence: Synthetic oligonucleotide
acccucugcaaaugugauag

SEQ ID NO: 1348 - RNA, 20 nt, Artificial Sequence
  Description of Artificial Sequence: Synthetic oligonucleotide
cuuacccucugcaaauguga

SEQ ID NO: 1349 - RNA, 20 nt, Artificial Sequence
  Description of Artificial Sequence: Synthetic oligonucleotide
gucuuacccucugcaaaugu

SEQ ID NO: 1350 - RNA, 20 nt, Artificial Sequence
  Description of Artificial Sequence: Synthetic oligonucleotide
ugucuuacccucugcaaaug

SEQ ID NO: 1351 - RNA, 20 nt, Artificial Sequence
  Description of Artificial Sequence: Synthetic oligonucleotide
uugucuuacccucugcaaau

SEQ ID NO: 1352 - RNA, 20 nt, Artificial Sequence
  Description of Artificial Sequence: Synthetic oligonucleotide
cuugucuuacccucugcaaa

SEQ ID NO: 1353 - RNA, 20 nt, Artificial Sequence
  Description of Artificial Sequence: Synthetic oligonucleotide
ucuugucuuacccucugcaa

SEQ ID NO: 1354 - RNA, 20 nt, Artificial Sequence
  Description of Artificial Sequence: Synthetic oligonucleotide
cauucuugucuuacccucug

SEQ ID NO: 1355 - RNA, 20 nt, Artificial Sequence
  Description of Artificial Sequence: Synthetic oligonucleotide
cccauucuugucuuacccuc

SEQ ID NO: 1356 - RNA, 20 nt, Artificial Sequence
  Description of Artificial Sequence: Synthetic oligonucleotide
gagccucaucuugucccucc

SEQ ID NO: 1357 - RNA, 20 nt, Artificial Sequence
  Description of Artificial Sequence: Synthetic oligonucleotide
ugagccucaucuugucccuc

SEQ ID NO: 1358 - RNA, 20 nt, Artificial Sequence
  Description of Artificial Sequence: Synthetic oligonucleotide
ugcguuggugaugggaagga

SEQ ID NO: 1359 - RNA, 20 nt, Artificial Sequence
  Description of Artificial Sequence: Synthetic oligonucleotide
gugcguuggugaugggaagg

SEQ ID NO: 1360 - RNA, 20 nt, Artificial Sequence
  Description of Artificial Sequence: Synthetic oligonucleotide
ggugcguuggugaugggaag

SEQ ID NO: 1361 - RNA, 20 nt, Artificial Sequence
  Description of Artificial Sequence: Synthetic oligonucleotide
gggugcguuggugaugggaa

SEQ ID NO: 1362 - RNA, 20 nt, Artificial Sequence
  Description of Artificial Sequence: Synthetic oligonucleotide
ugggugcguuggugauggga

SEQ ID NO: 1363 - RNA, 20 nt, Artificial Sequence
  Description of Artificial Sequence: Synthetic oligonucleotide
ucucacaugccuggacgccu

SEQ ID NO: 1364 - RNA, 20 nt, Artificial Sequence
  Description of Artificial Sequence: Synthetic oligonucleotide
caaggcaggcucucacaugc

SEQ ID NO: 1365 - RNA, 20 nt, Artificial Sequence
  Description of Artificial Sequence: Synthetic oligonucleotide
ugcuguuuccuggcaaggca

SEQ ID NO: 1366 - RNA, 20 nt, Artificial Sequence
  Description of Artificial Sequence: Synthetic oligonucleotide
uugugcuguuuccuggcaag

SEQ ID NO: 1367 - RNA, 20 nt, Artificial Sequence
  Description of Artificial Sequence: Synthetic oligonucleotide
cuugugcuguuuccuggcaa

SEQ ID NO: 1368 - RNA, 20 nt, Artificial Sequence
  Description of Artificial Sequence: Synthetic oligonucleotide
accaccagggaaucuuacug

SEQ ID NO: 1369 - RNA, 20 nt, Artificial Sequence
  Description of Artificial Sequence: Synthetic oligonucleotide
uccaccaccagggaaucuua

SEQ ID NO: 1370 - RNA, 20 nt, Artificial Sequence
  Description of Artificial Sequence: Synthetic oligonucleotide
auuuccuuccaccaccaggg

SEQ ID NO: 1371 - RNA, 20 nt, Artificial Sequence
  Description of Artificial Sequence: Synthetic oligonucleotide
uauuuccuuccaccaccagg

SEQ ID NO: 1372 - RNA, 20 nt, Artificial Sequence
  Description of Artificial Sequence: Synthetic oligonucleotide
ccuauuuccuuccaccacca

SEQ ID NO: 1373 - RNA, 20 nt, Artificial Sequence
  Description of Artificial Sequence: Synthetic oligonucleotide
aguccuccuauuuccuucca

SEQ ID NO: 1374 - RNA, 20 nt, Artificial Sequence
  Description of Artificial Sequence: Synthetic oligonucleotide
agaguccuccuauuuccuuc

SEQ ID NO: 1375 - RNA, 20 nt, Artificial Sequence
  Description of Artificial Sequence: Synthetic oligonucleotide
agcagaguccuccuauuucc

SEQ ID NO: 1376 - RNA, 20 nt, Artificial Sequence
  Description of Artificial Sequence: Synthetic oligonucleotide
cagcagaguccuccuauuuc

SEQ ID NO: 1377 - RNA, 20 nt, Artificial Sequence
  Description of Artificial Sequence: Synthetic oligonucleotide
auucagcagaguccuccuau

SEQ ID NO: 1378 - RNA, 20 nt, Artificial Sequence
  Description of Artificial Sequence: Synthetic oligonucleotide
accaggauucagcagagucc

SEQ ID NO: 1379 - RNA, 20 nt, Artificial Sequence
  Description of Artificial Sequence: Synthetic oligonucleotide
gaccaggauucagcagaguc

SEQ ID NO: 1380 - RNA, 20 nt, Artificial Sequence
  Description of Artificial Sequence: Synthetic oligonucleotide
ggaccaggauucagcagagu

SEQ ID NO: 1381 - RNA, 20 nt, Artificial Sequence
  Description of Artificial Sequence: Synthetic oligonucleotide
caggaccaggauucagcaga

SEQ ID NO: 1382 - RNA, 20 nt, Artificial Sequence
  Description of Artificial Sequence: Synthetic oligonucleotide
cagaagcaggaccaggauuc

SEQ ID NO: 1383 - RNA, 20 nt, Artificial Sequence
  Description of Artificial Sequence: Synthetic oligonucleotide
acagaagcaggaccaggauu

SEQ ID NO: 1384 - RNA, 20 nt, Artificial Sequence
  Description of Artificial Sequence: Synthetic oligonucleotide
aacagaagcaggaccaggau

SEQ ID NO: 1385 - RNA, 20 nt, Artificial Sequence
  Description of Artificial Sequence: Synthetic oligonucleotide
agaacagaagcaggaccagg

SEQ ID NO: 1386 - RNA, 20 nt, Artificial Sequence
  Description of Artificial Sequence: Synthetic oligonucleotide
gggagggaugagaacagaag

SEQ ID NO: 1387 - RNA, 20 nt, Artificial Sequence
  Description of Artificial Sequence: Synthetic oligonucleotide
caggcaacauacacacugca

SEQ ID NO: 1388 - RNA, 20 nt, Artificial Sequence
  Description of Artificial Sequence: Synthetic oligonucleotide
ccaggcaacauacacacugc

SEQ ID NO: 1389 - RNA, 20 nt, Artificial Sequence
  Description of Artificial Sequence: Synthetic oligonucleotide
accaggcaacauacacacug

SEQ ID NO: 1390 - RNA, 20 nt, Artificial Sequence
  Description of Artificial Sequence: Synthetic oligonucleotide
agaccaggcaacauacacac

SEQ ID NO: 1391 - RNA, 20 nt, Artificial Sequence
  Description of Artificial Sequence: Synthetic oligonucleotide
gagagaccaggcaacauaca

SEQ ID NO: 1392 - RNA, 20 nt, Artificial Sequence
  Description of Artificial Sequence: Synthetic oligonucleotide
ccagagagaccaggcaacau

SEQ ID NO: 1393 - RNA, 20 nt, Artificial Sequence
  Description of Artificial Sequence: Synthetic oligonucleotide
uuguuugggucaccucugca

SEQ ID NO: 1394 - RNA, 20 nt, Artificial Sequence
  Description of Artificial Sequence: Synthetic oligonucleotide
guuguuugggucaccucugc

SEQ ID NO: 1395 - RNA, 20 nt, Artificial Sequence
  Description of Artificial Sequence: Synthetic oligonucleotide
aguuguuugggucaccucug

SEQ ID NO: 1396 - RNA, 20 nt, Artificial Sequence
  Description of Artificial Sequence: Synthetic oligonucleotide
ugaguuguuugggucaccuc

SEQ ID NO: 1397 - RNA, 20 nt, Artificial Sequence
  Description of Artificial Sequence: Synthetic oligonucleotide
cugaguuguuugggucaccu

SEQ ID NO: 1398 - RNA, 20 nt, Artificial Sequence
  Description of Artificial Sequence: Synthetic oligonucleotide
gacugaguuguuugggucac

SEQ ID NO: 1399 - RNA, 20 nt, Artificial Sequence
  Description of Artificial Sequence: Synthetic oligonucleotide
aaacaggcaaggauaaggca

SEQ ID NO: 1400 - RNA, 20 nt, Artificial Sequence
  Description of Artificial Sequence: Synthetic oligonucleotide
acauggaaaagcugucauug

SEQ ID NO: 1401 - RNA, 20 nt, Artificial Sequence
  Description of Artificial Sequence: Synthetic oligonucleotide
ccuuacauggaaaagcuguc

SEQ ID NO: 1402 - RNA, 20 nt, Artificial Sequence
  Description of Artificial Sequence: Synthetic oligonucleotide
gccuuacauggaaaagcugu

SEQ ID NO: 1403 - RNA, 20 nt, Artificial Sequence
  Description of Artificial Sequence: Synthetic oligonucleotide
cuccuggaaccuagcaccau

SEQ ID NO: 1404 - RNA, 20 nt, Artificial Sequence
  Description of Artificial Sequence: Synthetic oligonucleotide
ccuccuggaaccuagcacca

SEQ ID NO: 1405 - RNA, 20 nt, Artificial Sequence
  Description of Artificial Sequence: Synthetic oligonucleotide
uccuccuggaaccuagcacc

SEQ ID NO: 1406 - RNA, 20 nt, Artificial Sequence
  Description of Artificial Sequence: Synthetic oligonucleotide
aaccauuaugccuccaugca

SEQ ID NO: 1407 - RNA, 20 nt, Artificial Sequence
  Description of Artificial Sequence: Synthetic oligonucleotide
uaaccauuaugccuccaugc

SEQ ID NO: 1408 - RNA, 20 nt, Artificial Sequence
  Description of Artificial Sequence: Synthetic oligonucleotide
cuaaccauuaugccuccaug

SEQ ID NO: 1409 - RNA, 20 nt, Artificial Sequence
  Description of Artificial Sequence: Synthetic oligonucleotide
ccuaaccauuaugccuccau

SEQ ID NO: 1410 - RNA, 20 nt, Artificial Sequence
  Description of Artificial Sequence: Synthetic oligonucleotide
cccuaaccauuaugccucca

SEQ ID NO: 1411 - RNA, 20 nt, Artificial Sequence
  Description of Artificial Sequence: Synthetic oligonucleotide
acucccuaaccauuaugccu

SEQ ID NO: 1412 - RNA, 20 nt, Artificial Sequence
  Description of Artificial Sequence: Synthetic oligonucleotide
gacucccuaaccauuaugcc

SEQ ID NO: 1413 - RNA, 20 nt, Artificial Sequence
  Description of Artificial Sequence: Synthetic oligonucleotide
ugacucccuaaccauuaugc

SEQ ID NO: 1414 - RNA, 20 nt, Artificial Sequence
  Description of Artificial Sequence: Synthetic oligonucleotide
augacucccuaaccauuaug

SEQ ID NO: 1415 - RNA, 20 nt, Artificial Sequence
  Description of Artificial Sequence: Synthetic oligonucleotide
caugacucccuaaccauuau

SEQ ID NO: 1416 - RNA, 20 nt, Artificial Sequence
  Description of Artificial Sequence: Synthetic oligonucleotide
gggccucuucaugguugugu

SEQ ID NO: 1417 - RNA, 20 nt, Artificial Sequence
  Description of Artificial Sequence: Synthetic oligonucleotide
uggugcagccugguaauggg

SEQ ID NO: 1418 - RNA, 20 nt, Artificial Sequence
  Description of Artificial Sequence: Synthetic oligonucleotide
cuggugcagccugguaaugg

SEQ ID NO: 1419 - RNA, 20 nt, Artificial Sequence
  Description of Artificial Sequence: Synthetic oligonucleotide
ccuggugcagccugguaaug

SEQ ID NO: 1420 - RNA, 20 nt, Artificial Sequence
  Description of Artificial Sequence: Synthetic oligonucleotide
auccuggugcagccugguaa

SEQ ID NO: 1421 - RNA, 20 nt, Artificial Sequence
  Description of Artificial Sequence: Synthetic oligonucleotide
uauccuggugcagccuggua

SEQ ID NO: 1422 - RNA, 20 nt, Artificial Sequence
  Description of Artificial Sequence: Synthetic oligonucleotide
guauccuggugcagccuggu

SEQ ID NO: 1423 - RNA, 20 nt, Artificial Sequence
  Description of Artificial Sequence: Synthetic oligonucleotide
uguauccuggugcagccugg

SEQ ID NO: 1424 - RNA, 20 nt, Artificial Sequence
  Description of Artificial Sequence: Synthetic oligonucleotide
ucuuguauccuggugcagcc

SEQ ID NO: 1425 - RNA, 20 nt, Artificial Sequence
  Description of Artificial Sequence: Synthetic oligonucleotide
gucuuguauccuggugcagc

SEQ ID NO: 1426 - RNA, 20 nt, Artificial Sequence
  Description of Artificial Sequence: Synthetic oligonucleotide
ugucuuguauccuggugcag

SEQ ID NO: 1427 - RNA, 20 nt, Artificial Sequence
  Description of Artificial Sequence: Synthetic oligonucleotide
uugucuuguauccuggugca

SEQ ID NO: 1428 - RNA, 20 nt, Artificial Sequence
  Description of Artificial Sequence: Synthetic oligonucleotide
cuugucuuguauccuggugc

SEQ ID NO: 1429 - RNA, 20 nt, Artificial Sequence
  Description of Artificial Sequence: Synthetic oligonucleotide
ucuugucuuguauccuggug

SEQ ID NO: 1430 - RNA, 20 nt, Artificial Sequence
  Description of Artificial Sequence: Synthetic oligonucleotide
uucuugucuuguauccuggu

SEQ ID NO: 1431 - RNA, 20 nt, Artificial Sequence
  Description of Artificial Sequence: Synthetic oligonucleotide
uuucuugucuuguauccugg

SEQ ID NO: 1432 - RNA, 20 nt, Artificial Sequence
  Description of Artificial Sequence: Synthetic oligonucleotide
ccuuucuugucuuguauccu

SEQ ID NO: 1433 - RNA, 20 nt, Artificial Sequence
  Description of Artificial Sequence: Synthetic oligonucleotide
acucauccuuuccuuucuug

SEQ ID NO: 1434 - RNA, 20 nt, Artificial Sequence
  Description of Artificial Sequence: Synthetic oligonucleotide
ccuacucauccuuuccuuuc

SEQ ID NO: 1435 - RNA, 20 nt, Artificial Sequence
  Description of Artificial Sequence: Synthetic oligonucleotide
cccuacucauccuuuccuuu

SEQ ID NO: 1436 - RNA, 20 nt, Artificial Sequence
  Description of Artificial Sequence: Synthetic oligonucleotide
ucccuacucauccuuuccuu

SEQ ID NO: 1437 - RNA, 20 nt, Artificial Sequence
  Description of Artificial Sequence: Synthetic oligonucleotide
gcuucuuaguaugucccuac

SEQ ID NO: 1438 - RNA, 20 nt, Artificial Sequence
  Description of Artificial Sequence: Synthetic oligonucleotide
gcugcuucuuaguauguccc

SEQ ID NO: 1439 - RNA, 20 nt, Artificial Sequence
  Description of Artificial Sequence: Synthetic oligonucleotide
ggcugcuucuuaguaugucc

SEQ ID NO: 1440 - RNA, 20 nt, Artificial Sequence
  Description of Artificial Sequence: Synthetic oligonucleotide
gggcugcuucuuaguauguc

SEQ ID NO: 1441 - RNA, 20 nt, Artificial Sequence
  Description of Artificial Sequence: Synthetic oligonucleotide
agggcugcuucuuaguaugu

SEQ ID NO: 1442 - RNA, 20 nt, Artificial Sequence
  Description of Artificial Sequence: Synthetic oligonucleotide
gagagggcugcuucuuagua

SEQ ID NO: 1443 - RNA, 20 nt, Artificial Sequence
  Description of Artificial Sequence: Synthetic oligonucleotide
uccaagaggagagggcugcu

SEQ ID NO: 1444 - RNA, 20 nt, Artificial Sequence
  Description of Artificial Sequence: Synthetic oligonucleotide
uugacuuuuccaagaggaga

SEQ ID NO: 1445 - RNA, 20 nt, Artificial Sequence
  Description of Artificial Sequence: Synthetic oligonucleotide
agcucuauccaucugccagg

SEQ ID NO: 1446 - RNA, 20 nt, Artificial Sequence
  Description of Artificial Sequence: Synthetic oligonucleotide
gcuguuacuugagcagaggc

SEQ ID NO: 1447 - RNA, 20 nt, Artificial Sequence
  Description of Artificial Sequence: Synthetic oligonucleotide
ggcuguuacuugagcagagg

SEQ ID NO: 1448 - RNA, 20 nt, Artificial Sequence
  Description of Artificial Sequence: Synthetic oligonucleotide
uggcuguuacuugagcagag

SEQ ID NO: 1449 - RNA, 20 nt, Artificial Sequence
  Description of Artificial Sequence: Synthetic oligonucleotide
cuggcuguuacuugagcaga

SEQ ID NO: 1450 - RNA, 20 nt, Artificial Sequence
  Description of Artificial Sequence: Synthetic oligonucleotide
ucuggcuguuacuugagcag

SEQ ID NO: 1451 - RNA, 20 nt, Artificial Sequence
  Description of Artificial Sequence: Synthetic oligonucleotide
ccucaaguucuggcuguuac

SEQ ID NO: 1452 - RNA, 20 nt, Artificial Sequence
  Description of Artificial Sequence: Synthetic oligonucleotide
accucaaguucuggcuguua

SEQ ID NO: 1453 - RNA, 20 nt, Artificial Sequence
  Description of Artificial Sequence: Synthetic oligonucleotide
caaccucaaguucuggcugu

SEQ ID NO: 1454 - RNA, 20 nt, Artificial Sequence
  Description of Artificial Sequence: Synthetic oligonucleotide
gcaaccucaaguucuggcug

SEQ ID NO: 1455 - RNA, 20 nt, Artificial Sequence
  Description of Artificial Sequence: Synthetic oligonucleotide
agcaaccucaaguucuggcu

SEQ ID NO: 1456 - RNA, 20 nt, Artificial Sequence
  Description of Artificial Sequence: Synthetic oligonucleotide
caagcaaccucaaguucugg

SEQ ID NO: 1457 - RNA, 20 nt, Artificial Sequence
  Description of Artificial Sequence: Synthetic oligonucleotide
ccaagcaaccucaaguucug

SEQ ID NO: 1458 - RNA, 20 nt, Artificial Sequence
  Description of Artificial Sequence: Synthetic oligonucleotide
cccaagcaaccucaaguucu

SEQ ID NO: 1459 - RNA, 20 nt, Artificial Sequence
  Description of Artificial Sequence: Synthetic oligonucleotide
acuaagacagugcuccuggu

SEQ ID NO: 1460 - RNA, 20 nt, Artificial Sequence
  Description of Artificial Sequence: Synthetic oligonucleotide
caaacuaagacagugcuccu

SEQ ID NO: 1461 - RNA, 20 nt, Artificial Sequence
  Description of Artificial Sequence: Synthetic oligonucleotide
agcucugcuuuggaagaacc

SEQ ID NO: 1462 - RNA, 20 nt, Artificial Sequence
  Description of Artificial Sequence: Synthetic oligonucleotide
cccuuagcucaagcucugcu

SEQ ID NO: 1463 - RNA, 20 nt, Artificial Sequence
  Description of Artificial Sequence: Synthetic oligonucleotide
gcccuuagcucaagcucugc

SEQ ID NO: 1464 - RNA, 20 nt, Artificial Sequence
  Description of Artificial Sequence: Synthetic oligonucleotide
aagcccuuagcucaagcucu

SEQ ID NO: 1465 - RNA, 20 nt, Artificial Sequence
  Description of Artificial Sequence: Synthetic oligonucleotide
caagcccuuagcucaagcuc

SEQ ID NO: 1466 - RNA, 20 nt, Artificial Sequence
  Description of Artificial Sequence: Synthetic oligonucleotide
ccaagcccuuagcucaagcu

SEQ ID NO: 1467 - RNA, 20 nt, Artificial Sequence
  Description of Artificial Sequence: Synthetic oligonucleotide
cccaagcccuuagcucaagc

SEQ ID NO: 1468 - RNA, 20 nt, Artificial Sequence
  Description of Artificial Sequence: Synthetic oligonucleotide
guacccaagcccuuagcuca

SEQ ID NO: 1469 - RNA, 20 nt, Artificial Sequence
  Description of Artificial Sequence: Synthetic oligonucleotide
uguacccaagcccuuagcuc

SEQ ID NO: 1470 - RNA, 20 nt, Artificial Sequence
  Description of Artificial Sequence: Synthetic oligonucleotide
cuguacccaagcccuuagcu

SEQ ID NO: 1471 - RNA, 20 nt, Artificial Sequence
  Description of Artificial Sequence: Synthetic oligonucleotide
ccuguacccaagcccuuagc

SEQ ID NO: 1472 - RNA, 20 nt, Artificial Sequence
  Description of Artificial Sequence: Synthetic oligonucleotide
accuguacccaagcccuuag

SEQ ID NO: 1473 - RNA, 20 nt, Artificial Sequence
  Description of Artificial Sequence: Synthetic oligonucleotide
ucaccuguacccaagcccuu

SEQ ID NO: 1474 - RNA, 20 nt, Artificial Sequence
  Description of Artificial Sequence: Synthetic oligonucleotide
aucaccuguacccaagcccu

SEQ ID NO: 1475 - RNA, 20 nt, Artificial Sequence
  Description of Artificial Sequence: Synthetic oligonucleotide
ggaucaccuguacccaagcc

SEQ ID NO: 1476 - RNA, 20 nt, Artificial Sequence
  Description of Artificial Sequence: Synthetic oligonucleotide
cucaagaauacaggaucacc

SEQ ID NO: 1477 - RNA, 20 nt, Artificial Sequence
  Description of Artificial Sequence: Synthetic oligonucleotide
cuuagcucaagaauacagga

SEQ ID NO: 1478 - RNA, 20 nt, Artificial Sequence
  Description of Artificial Sequence: Synthetic oligonucleotide
ccuuagcucaagaauacagg

SEQ ID NO: 1479 - RNA, 20 nt, Artificial Sequence
  Description of Artificial Sequence: Synthetic oligonucleotide
gcccuuagcucaagaauaca

SEQ ID NO: 1480 - RNA, 20 nt, Artificial Sequence
  Description of Artificial Sequence: Synthetic oligonucleotide
agcccuuagcucaagaauac

SEQ ID NO: 1481 - RNA, 20 nt, Artificial Sequence
  Description of Artificial Sequence: Synthetic oligonucleotide
aagcccuuagcucaagaaua

SEQ ID NO: 1482 - RNA, 20 nt, Artificial Sequence
  Description of Artificial Sequence: Synthetic oligonucleotide
caagcccuuagcucaagaau

SEQ ID NO: 1483 - RNA, 20 nt, Artificial Sequence
  Description of Artificial Sequence: Synthetic oligonucleotide
ccaagcccuuagcucaagaa

SEQ ID NO: 1484 - RNA, 20 nt, Artificial Sequence
  Description of Artificial Sequence: Synthetic oligonucleotide
cccaagcccuuagcucaaga

SEQ ID NO: 1485 - RNA, 20 nt, Artificial Sequence
  Description of Artificial Sequence: Synthetic oligonucleotide
guacccaagcccuuagcuca

SEQ ID NO: 1486 - RNA, 20 nt, Artificial Sequence
  Description of Artificial Sequence: Synthetic oligonucleotide
uguacccaagcccuuagcuc

SEQ ID NO: 1487 - RNA, 20 nt, Artificial Sequence
  Description of Artificial Sequence: Synthetic oligonucleotide
cuguacccaagcccuuagcu

SEQ ID NO: 1488 - RNA, 20 nt, Artificial Sequence
  Description of Artificial Sequence: Synthetic oligonucleotide
ccuguacccaagcccuuagc

SEQ ID NO: 1489 - RNA, 20 nt, Artificial Sequence
  Description of Artificial Sequence: Synthetic oligonucleotide
accuguacccaagcccuuag

SEQ ID NO: 1490 - RNA, 20 nt, Artificial Sequence
  Description of Artificial Sequence: Synthetic oligonucleotide
ucaccuguacccaagcccuu

SEQ ID NO: 1491 - RNA, 20 nt, Artificial Sequence
  Description of Artificial Sequence: Synthetic oligonucleotide
aucaccuguacccaagcccu

SEQ ID NO: 1492 - RNA, 20 nt, Artificial Sequence
  Description of Artificial Sequence: Synthetic oligonucleotide
ggaucaccuguacccaagcc

SEQ ID NO: 1493 - RNA, 20 nt, Artificial Sequence
  Description of Artificial Sequence: Synthetic oligonucleotide
uaaccucccaaauacaggau

SEQ ID NO: 1494 - RNA, 20 nt, Artificial Sequence
  Description of Artificial Sequence: Synthetic oligonucleotide
uaccuuaugcccucacuucc

SEQ ID NO: 1495 - RNA, 20 nt, Artificial Sequence
  Description of Artificial Sequence: Synthetic oligonucleotide
uuaccuuaugcccucacuuc

SEQ ID NO: 1496 - RNA, 20 nt, Artificial Sequence
  Description of Artificial Sequence: Synthetic oligonucleotide
uuuaccuuaugcccucacuu

SEQ ID NO: 1497 - RNA, 20 nt, Artificial Sequence
  Description of Artificial Sequence: Synthetic oligonucleotide
uuuuaccuuaugcccucacu

SEQ ID NO: 1498 - RNA, 20 nt, Artificial Sequence
  Description of Artificial Sequence: Synthetic oligonucleotide
uuguuuuaccuuaugcccuc

SEQ ID NO: 1499 - RNA, 20 nt, Artificial Sequence
  Description of Artificial Sequence: Synthetic oligonucleotide
cuuguuuuaccuuaugcccu

SEQ ID NO: 1500 - RNA, 20 nt, Artificial Sequence
  Description of Artificial Sequence: Synthetic oligonucleotide
uuaauggcuuuccucucucu

SEQ ID NO: 1501 - RNA, 20 nt, Artificial Sequence
  Description of Artificial Sequence: Synthetic oligonucleotide
acucuuaauggcuuuccucu

SEQ ID NO: 1502 - RNA, 20 nt, Artificial Sequence
  Description of Artificial Sequence: Synthetic oligonucleotide
uacucuuaauggcuuuccuc

SEQ ID NO: 1503 - RNA, 20 nt, Artificial Sequence
  Description of Artificial Sequence: Synthetic oligonucleotide
cauacucuuaauggcuuucc

SEQ ID NO: 1504 - RNA, 20 nt, Artificial Sequence
  Description of Artificial Sequence: Synthetic oligonucleotide
gaagggacuuaacauacucu

SEQ ID NO: 1505 - RNA, 20 nt, Artificial Sequence
  Description of Artificial Sequence: Synthetic oligonucleotide
ugaagggacuuaacauacuc

SEQ ID NO: 1506 - RNA, 20 nt, Artificial Sequence
  Description of Artificial Sequence: Synthetic oligonucleotide
acugaagggacuuaacauac

SEQ ID NO: 1507 - RNA, 20 nt, Artificial Sequence
  Description of Artificial Sequence: Synthetic oligonucleotide
cuacugaagggacuuaacau

SEQ ID NO: 1508 - RNA, 20 nt, Artificial Sequence
  Description of Artificial Sequence: Synthetic oligonucleotide
gccuacugaagggacuuaac

SEQ ID NO: 1509 - RNA, 20 nt, Artificial Sequence
  Description of Artificial Sequence: Synthetic oligonucleotide
ggccuacugaagggacuuaa

SEQ ID NO: 1510 - RNA, 20 nt, Artificial Sequence
  Description of Artificial Sequence: Synthetic oligonucleotide
uucucagagguucccaaggc

SEQ ID NO: 1511 - RNA, 20 nt, Artificial Sequence
  Description of Artificial Sequence: Synthetic oligonucleotide
uuuucucagagguucccaag

SEQ ID NO: 1512 - RNA, 20 nt, Artificial Sequence
  Description of Artificial Sequence: Synthetic oligonucleotide
acuuuucucagagguuccca

SEQ ID NO: 1513 - RNA, 20 nt, Artificial Sequence
  Description of Artificial Sequence: Synthetic oligonucleotide
uacuuuucucagagguuccc

SEQ ID NO: 1514 - RNA, 20 nt, Artificial Sequence
  Description of Artificial Sequence: Synthetic oligonucleotide
gggcaaucuauacuuuucuc

SEQ ID NO: 1515 - RNA, 20 nt, Artificial Sequence
  Description of Artificial Sequence: Synthetic oligonucleotide
ugucuugggcaaucuauacu

SEQ ID NO: 1516 - RNA, 20 nt, Artificial Sequence
  Description of Artificial Sequence: Synthetic oligonucleotide
ccagucuuuugucuugggca

SEQ ID NO: 1517 - RNA, 20 nt, Artificial Sequence
  Description of Artificial Sequence: Synthetic oligonucleotide
gccagucuuuugucuugggc

SEQ ID NO: 1518 - RNA, 20 nt, Artificial Sequence
  Description of Artificial Sequence: Synthetic oligonucleotide
ugccagucuuuugucuuggg

SEQ ID NO: 1519 - RNA, 20 nt, Artificial Sequence
  Description of Artificial Sequence: Synthetic oligonucleotide
cugccagucuuuugucuugg

SEQ ID NO: 1520 - RNA, 20 nt, Artificial Sequence
  Description of Artificial Sequence: Synthetic oligonucleotide
ucacccugccagucuuuugu

SEQ ID NO: 1521 - RNA, 20 nt, Artificial Sequence
  Description of Artificial Sequence: Synthetic oligonucleotide
aucacccugccagucuuuug

SEQ ID NO: 1522 - RNA, 20 nt, Artificial Sequence
  Description of Artificial Sequence: Synthetic oligonucleotide
gcccacucauuaaguacauu

SEQ ID NO: 1523 - RNA, 20 nt, Artificial Sequence
  Description of Artificial Sequence: Synthetic oligonucleotide
cuguagcccacucauuaagu

SEQ ID NO: 1524 - RNA, 20 nt, Artificial Sequence
  Description of Artificial Sequence: Synthetic oligonucleotide
cgcuguagcccacucauuaa

SEQ ID NO: 1525 - RNA, 20 nt, Artificial Sequence
  Description of Artificial Sequence: Synthetic oligonucleotide
acgcuguagcccacucauua

SEQ ID NO: 1526 - RNA, 20 nt, Artificial Sequence
  Description of Artificial Sequence: Synthetic oligonucleotide
uacgcuguagcccacucauu

SEQ ID NO: 1527 - RNA, 20 nt, Artificial Sequence
  Description of Artificial Sequence: Synthetic oligonucleotide
auacgcuguagcccacucau

SEQ ID NO: 1528 - RNA, 20 nt, Artificial Sequence
  Description of Artificial Sequence: Synthetic oligonucleotide
gauacgcuguagcccacuca

SEQ ID NO: 1529 - RNA, 20 nt, Artificial Sequence
  Description of Artificial Sequence: Synthetic oligonucleotide
ggauacgcuguagcccacuc

SEQ ID NO: 1530 - RNA, 20 nt, Artificial Sequence
  Description of Artificial Sequence: Synthetic oligonucleotide
aggauacgcuguagcccacu

SEQ ID NO: 1531 - RNA, 20 nt, Artificial Sequence
  Description of Artificial Sequence: Synthetic oligonucleotide
gaggauacgcuguagcccac

SEQ ID NO: 1532 - RNA, 20 nt, Artificial Sequence
  Description of Artificial Sequence: Synthetic oligonucleotide
ugaggauacgcuguagccca

SEQ ID NO: 1533 - RNA, 20 nt, Artificial Sequence
  Description of Artificial Sequence: Synthetic oligonucleotide
gugaggauacgcuguagccc

SEQ ID NO: 1534 - RNA, 20 nt, Artificial Sequence
  Description of Artificial Sequence: Synthetic oligonucleotide
ugugaggauacgcuguagcc

SEQ ID NO: 1535 - RNA, 20 nt, Artificial Sequence
  Description of Artificial Sequence: Synthetic oligonucleotide
cuguugugaggauacgcugu

SEQ ID NO: 1536 - RNA, 20 nt, Artificial Sequence
  Description of Artificial Sequence: Synthetic oligonucleotide
ucuguugugaggauacgcug

SEQ ID NO: 1537 - RNA, 20 nt, Artificial Sequence
  Description of Artificial Sequence: Synthetic oligonucleotide
gucuguugugaggauacgcu

SEQ ID NO: 1538 - RNA, 20 nt, Artificial Sequence
  Description of Artificial Sequence: Synthetic oligonucleotide
ugucuguugugaggauacgc

SEQ ID NO: 1539 - RNA, 20 nt, Artificial Sequence
  Description of Artificial Sequence: Synthetic oligonucleotide
acugucuguugugaggauac

SEQ ID NO: 1540 - RNA, 20 nt, Artificial Sequence
  Description of Artificial Sequence: Synthetic oligonucleotide
cacugucuguugugaggaua

SEQ ID NO: 1541 - RNA, 20 nt, Artificial Sequence
  Description of Artificial Sequence: Synthetic oligonucleotide
caacucucucucacugucug

SEQ ID NO: 1542 - RNA, 20 nt, Artificial Sequence
  Description of Artificial Sequence: Synthetic oligonucleotide
aacaacucucucucacuguc

SEQ ID NO: 1543 - RNA, 20 nt, Artificial Sequence
  Description of Artificial Sequence: Synthetic oligonucleotide
agaacaacucucucucacug

SEQ ID NO: 1544 - RNA, 20 nt, Artificial Sequence
  Description of Artificial Sequence: Synthetic oligonucleotide
guagaacaacucucucucac

SEQ ID NO: 1545 - RNA, 20 nt, Artificial Sequence
  Description of Artificial Sequence: Synthetic oligonucleotide
gguagaacaacucucucuca

SEQ ID NO: 1546 - RNA, 20 nt, Artificial Sequence
  Description of Artificial Sequence: Synthetic oligonucleotide
cagguagaacaacucucucu

SEQ ID NO: 1547 - RNA, 20 nt, Artificial Sequence
  Description of Artificial Sequence: Synthetic oligonucleotide
ccagguagaacaacucucuc

SEQ ID NO: 1548 - RNA, 20 nt, Artificial Sequence
  Description of Artificial Sequence: Synthetic oligonucleotide
acccagguagaacaacucuc

SEQ ID NO: 1549 - RNA, 20 nt, Artificial Sequence
  Description of Artificial Sequence: Synthetic oligonucleotide
uauacccagguagaacaacu

SEQ ID NO: 1550 - RNA, 20 nt, Artificial Sequence
  Description of Artificial Sequence: Synthetic oligonucleotide
auauacccagguagaacaac

SEQ ID NO: 1551 - RNA, 20 nt, Artificial Sequence
  Description of Artificial Sequence: Synthetic oligonucleotide
ggauauacccagguagaaca

SEQ ID NO: 1552 - RNA, 20 nt, Artificial Sequence
  Description of Artificial Sequence: Synthetic oligonucleotide
guuuuggauauacccaggua

SEQ ID NO: 1553 - RNA, 20 nt, Artificial Sequence
  Description of Artificial Sequence: Synthetic oligonucleotide
ccuuguuuuggauauaccca

SEQ ID NO: 1554 - RNA, 20 nt, Artificial Sequence
  Description of Artificial Sequence: Synthetic oligonucleotide
cccuuguuuuggauauaccc

SEQ ID NO: 1555 - RNA, 20 nt, Artificial Sequence
  Description of Artificial Sequence: Synthetic oligonucleotide
ccucguaaacuccauacccu

SEQ ID NO: 1556 - RNA, 20 nt, Artificial Sequence
  Description of Artificial Sequence: Synthetic oligonucleotide
cccucguaaacuccauaccc

SEQ ID NO: 1557 - RNA, 20 nt, Artificial Sequence
  Description of Artificial Sequence: Synthetic oligonucleotide
acccucguaaacuccauacc

SEQ ID NO: 1558 - RNA, 20 nt, Artificial Sequence
  Description of Artificial Sequence: Synthetic oligonucleotide
aacccucguaaacuccauac

SEQ ID NO: 1559 - RNA, 20 nt, Artificial Sequence
  Description of Artificial Sequence: Synthetic oligonucleotide
gaacccucguaaacuccaua

SEQ ID NO: 1560 - RNA, 20 nt, Artificial Sequence
  Description of Artificial Sequence: Synthetic oligonucleotide
ugaacccucguaaacuccau

SEQ ID NO: 1561 - RNA, 20 nt, Artificial Sequence
  Description of Artificial Sequence: Synthetic oligonucleotide
uugaacccucguaaacucca

SEQ ID NO: 1562 - RNA, 20 nt, Artificial Sequence
  Description of Artificial Sequence: Synthetic oligonucleotide
cuugaacccucguaaacucc

SEQ ID NO: 1563 - RNA, 20 nt, Artificial Sequence
  Description of Artificial Sequence: Synthetic oligonucleotide
ccuugaacccucguaaacuc

SEQ ID NO: 1564 - RNA, 20 nt, Artificial Sequence
  Description of Artificial Sequence: Synthetic oligonucleotide
accuugaacccucguaaacu

SEQ ID NO: 1565 - RNA, 20 nt, Artificial Sequence
  Description of Artificial Sequence: Synthetic oligonucleotide
uaccuugaacccucguaaac

SEQ ID NO: 1566 - RNA, 20 nt, Artificial Sequence
  Description of Artificial Sequence: Synthetic oligonucleotide
auaccuugaacccucguaaa

SEQ ID NO: 1567 - RNA, 20 nt, Artificial Sequence
  Description of Artificial Sequence: Synthetic oligonucleotide
aauaccuugaacccucguaa

SEQ ID NO: 1568 - RNA, 20 nt, Artificial Sequence
  Description of Artificial Sequence: Synthetic oligonucleotide
aaauaccuugaacccucgua

SEQ ID NO: 1569 - RNA, 20 nt, Artificial Sequence
  Description of Artificial Sequence: Synthetic oligonucleotide
caaauaccuugaacccucgu

SEQ ID NO: 1570 - RNA, 20 nt, Artificial Sequence
  Description of Artificial Sequence: Synthetic oligonucleotide
ccaaauaccuugaacccucg

SEQ ID NO: 1571 - RNA, 20 nt, Artificial Sequence
  Description of Artificial Sequence: Synthetic oligonucleotide
accaaauaccuugaacccuc

SEQ ID NO: 1572 - RNA, 20 nt, Artificial Sequence
  Description of Artificial Sequence: Synthetic oligonucleotide
aaccaaauaccuugaacccu

SEQ ID NO: 1573 - RNA, 20 nt, Artificial Sequence
  Description of Artificial Sequence: Synthetic oligonucleotide
gaaccaaauaccuugaaccc

SEQ ID NO: 1574 - RNA, 20 nt, Artificial Sequence
  Description of Artificial Sequence: Synthetic oligonucleotide
ugaaccaaauaccuugaacc

SEQ ID NO: 1575 - RNA, 20 nt, Artificial Sequence
  Description of Artificial Sequence: Synthetic oligonucleotide
cccugaaccaaauaccuuga

SEQ ID NO: 1576 - RNA, 20 nt, Artificial Sequence
  Description of Artificial Sequence: Synthetic oligonucleotide
ggcccugaaccaaauaccuu

SEQ ID NO: 1577 - RNA, 20 nt, Artificial Sequence
  Description of Artificial Sequence: Synthetic oligonucleotide
uggcccugaaccaaauaccu

SEQ ID NO: 1578 - RNA, 20 nt, Artificial Sequence
  Description of Artificial Sequence: Synthetic oligonucleotide
uauucagguuguugcccaaa

SEQ ID NO: 1579 - RNA, 20 nt, Artificial Sequence
  Description of Artificial Sequence: Synthetic oligonucleotide
gguauucagguuguugccca

SEQ ID NO: 1580 - RNA, 20 nt, Artificial Sequence
  Description of Artificial Sequence: Synthetic oligonucleotide
agguauucagguuguugccc

SEQ ID NO: 1581 - RNA, 20 nt, Artificial Sequence
  Description of Artificial Sequence: Synthetic oligonucleotide
aagguauucagguuguugcc

SEQ ID NO: 1582 - RNA, 20 nt, Artificial Sequence
  Description of Artificial Sequence: Synthetic oligonucleotide
aaagguauucagguuguugc

SEQ ID NO: 1583 - RNA, 20 nt, Artificial Sequence
  Description of Artificial Sequence: Synthetic oligonucleotide
uaacuugauugcccugugac

SEQ ID NO: 1584 - RNA, 20 nt, Artificial Sequence
  Description of Artificial Sequence: Synthetic oligonucleotide
guaacuugauugcccuguga

SEQ ID NO: 1585 - RNA, 20 nt, Artificial Sequence
  Description of Artificial Sequence: Synthetic oligonucleotide
aguaacuugauugcccugug

SEQ ID NO: 1586 - RNA, 20 nt, Artificial Sequence
  Description of Artificial Sequence: Synthetic oligonucleotide
cagaguaacuugauugcccu

SEQ ID NO: 1587 - RNA, 20 nt, Artificial Sequence
  Description of Artificial Sequence: Synthetic oligonucleotide
acagaguaacuugauugccc

SEQ ID NO: 1588 - RNA, 20 nt, Artificial Sequence
  Description of Artificial Sequence: Synthetic oligonucleotide
cacagaguaacuugauugcc

SEQ ID NO: 1589 - RNA, 20 nt, Artificial Sequence
  Description of Artificial Sequence: Synthetic oligonucleotide
uguccugacaaagaaacaca

SEQ ID NO: 1590 - RNA, 20 nt, Artificial Sequence
  Description of Artificial Sequence: Synthetic oligonucleotide
caaucccugcuuuccugcca

SEQ ID NO: 1591 - RNA, 20 nt, Artificial Sequence
  Description of Artificial Sequence: Synthetic oligonucleotide
acaaucccugcuuuccugcc

SEQ ID NO: 1592 - RNA, 20 nt, Artificial Sequence
  Description of Artificial Sequence: Synthetic oligonucleotide
aacacaaucccugcuuuccu

SEQ ID NO: 1593 - RNA, 20 nt, Artificial Sequence
  Description of Artificial Sequence: Synthetic oligonucleotide
gaacacaaucccugcuuucc

SEQ ID NO: 1594 - RNA, 20 nt, Artificial Sequence
  Description of Artificial Sequence: Synthetic oligonucleotide
aaugaacacaaucccugcuu

SEQ ID NO: 1595 - RNA, 20 nt, Artificial Sequence
  Description of Artificial Sequence: Synthetic oligonucleotide
aaaugaacacaaucccugcu

SEQ ID NO: 1596 - RNA, 20 nt, Artificial Sequence
  Description of Artificial Sequence: Synthetic oligonucleotide
gugaaacccucaaaugaaca

SEQ ID NO: 1597 - RNA, 20 nt, Artificial Sequence
  Description of Artificial Sequence: Synthetic oligonucleotide
agugaaacccucaaaugaac

SEQ ID NO: 1598 - RNA, 20 nt, Artificial Sequence
  Description of Artificial Sequence: Synthetic oligonucleotide
cagugaaacccucaaaugaa

SEQ ID NO: 1599 - RNA, 20 nt, Artificial Sequence
  Description of Artificial Sequence: Synthetic oligonucleotide
acagugaaacccucaaauga

SEQ ID NO: 1600 - RNA, 20 nt, Artificial Sequence
  Description of Artificial Sequence: Synthetic oligonucleotide
gcauggaagcugagacucuc

SEQ ID NO: 1601 - RNA, 20 nt, Artificial Sequence
  Description of Artificial Sequence: Synthetic oligonucleotide
uugcauggaagcugagacuc

SEQ ID NO: 1602 - RNA, 20 nt, Artificial Sequence
  Description of Artificial Sequence: Synthetic oligonucleotide
caguugcauggaagcugaga

SEQ ID NO: 1603 - RNA, 20 nt, Artificial Sequence
  Description of Artificial Sequence: Synthetic oligonucleotide
acaguugcauggaagcugag

SEQ ID NO: 1604 - RNA, 20 nt, Artificial Sequence
  Description of Artificial Sequence: Synthetic oligonucleotide
gacaguugcauggaagcuga

SEQ ID NO: 1605 - RNA, 20 nt, Artificial Sequence
  Description of Artificial Sequence: Synthetic oligonucleotide
auggacaguugcauggaagc

SEQ ID NO: 1606 - RNA, 20 nt, Artificial Sequence
  Description of Artificial Sequence: Synthetic oligonucleotide
gugauggacaguugcaugga

SEQ ID NO: 1607 - RNA, 20 nt, Artificial Sequence
  Description of Artificial Sequence: Synthetic oligonucleotide
cgugauggacaguugcaugg

SEQ ID NO: 1608 - RNA, 20 nt, Artificial Sequence
  Description of Artificial Sequence: Synthetic oligonucleotide
ccgugauggacaguugcaug

SEQ ID NO: 1609 - RNA, 20 nt, Artificial Sequence
  Description of Artificial Sequence: Synthetic oligonucleotide
gccgugauggacaguugcau

SEQ ID NO: 1610 - RNA, 20 nt, Artificial Sequence
  Description of Artificial Sequence: Synthetic oligonucleotide
agccgugauggacaguugca

SEQ ID NO: 1611 - RNA, 20 nt, Artificial Sequence
  Description of Artificial Sequence: Synthetic oligonucleotide
cagccgugauggacaguugc

SEQ ID NO: 1612 - RNA, 20 nt, Artificial Sequence
  Description of Artificial Sequence: Synthetic oligonucleotide
gcagccgugauggacaguug

SEQ ID NO: 1613 - RNA, 20 nt, Artificial Sequence
  Description of Artificial Sequence: Synthetic oligonucleotide
ugcagccgugauggacaguu

SEQ ID NO: 1614 - RNA, 20 nt, Artificial Sequence
  Description of Artificial Sequence: Synthetic oligonucleotide
uugcagccgugauggacagu

SEQ ID NO: 1615 - RNA, 20 nt, Artificial Sequence
  Description of Artificial Sequence: Synthetic oligonucleotide
guugcagccgugauggacag

SEQ ID NO: 1616 - RNA, 20 nt, Artificial Sequence
  Description of Artificial Sequence: Synthetic oligonucleotide
caguugcagccgugauggac

SEQ ID NO: 1617 - RNA, 20 nt, Artificial Sequence
  Description of Artificial Sequence: Synthetic oligonucleotide
ucaguugcagccgugaugga

SEQ ID NO: 1618 - RNA, 20 nt, Artificial Sequence
  Description of Artificial Sequence: Synthetic oligonucleotide
uucaguugcagccgugaugg

SEQ ID NO: 1619 - RNA, 20 nt, Artificial Sequence
  Description of Artificial Sequence: Synthetic oligonucleotide
uuucaguugcagccgugaug

SEQ ID NO: 1620 - RNA, 20 nt, Artificial Sequence
  Description of Artificial Sequence: Synthetic oligonucleotide
auuucaguugcagccgugau

SEQ ID NO: 1621 - RNA, 20 nt, Artificial Sequence
  Description of Artificial Sequence: Synthetic oligonucleotide
gauuucaguugcagccguga

SEQ ID NO: 1622 - RNA, 20 nt, Artificial Sequence
  Description of Artificial Sequence: Synthetic oligonucleotide
ugauuucaguugcagccgug

SEQ ID NO: 1623 - RNA, 20 nt, Artificial Sequence
  Description of Artificial Sequence: Synthetic oligonucleotide
cucugauuucaguugcagcc

SEQ ID NO: 1624 - RNA, 20 nt, Artificial Sequence
  Description of Artificial Sequence: Synthetic oligonucleotide
uuagcuucuggugcgcugug

SEQ ID NO: 1625 - RNA, 20 nt, Artificial Sequence
  Description of Artificial Sequence: Synthetic oligonucleotide
uuuagcuucuggugcgcugu

SEQ ID NO: 1626 - RNA, 20 nt, Artificial Sequence
  Description of Artificial Sequence: Synthetic oligonucleotide
cuuuagcuucuggugcgcug

SEQ ID NO: 1627 - RNA, 20 nt, Artificial Sequence
  Description of Artificial Sequence: Synthetic oligonucleotide
gacuuuagcuucuggugcgc

SEQ ID NO: 1628 - RNA, 20 nt, Artificial Sequence
  Description of Artificial Sequence: Synthetic oligonucleotide
agacuuuagcuucuggugcg

SEQ ID NO: 1629 - RNA, 20 nt, Artificial Sequence
  Description of Artificial Sequence: Synthetic oligonucleotide
aagacuuuagcuucuggugc

SEQ ID NO: 1630 - RNA, 20 nt, Artificial Sequence
  Description of Artificial Sequence: Synthetic oligonucleotide
ucaagacuuuagcuucuggu

SEQ ID NO: 1631 - RNA, 20 nt, Artificial Sequence
  Description of Artificial Sequence: Synthetic oligonucleotide
aucaagacuuuagcuucugg

SEQ ID NO: 1632 - RNA, 20 nt, Artificial Sequence
  Description of Artificial Sequence: Synthetic oligonucleotide
gcaucaagacuuuagcuucu

SEQ ID NO: 1633 - RNA, 20 nt, Artificial Sequence
  Description of Artificial Sequence: Synthetic oligonucleotide
auggcaucaagacuuuagcu

SEQ ID NO: 1634 - RNA, 20 nt, Artificial Sequence
  Description of Artificial Sequence: Synthetic oligonucleotide
gauggcaucaagacuuuagc

SEQ ID NO: 1635 - RNA, 20 nt, Artificial Sequence
  Description of Artificial Sequence: Synthetic oligonucleotide
agggauguccuuugauggca

SEQ ID NO: 1636 - RNA, 20 nt, Artificial Sequence
  Description of Artificial Sequence: Synthetic oligonucleotide
gcagggauguccuuugaugg

SEQ ID NO: 1637 - RNA, 20 nt, Artificial Sequence
  Description of Artificial Sequence: Synthetic oligonucleotide
ggcagggauguccuuugaug

SEQ ID NO: 1638 - RNA, 20 nt, Artificial Sequence
  Description of Artificial Sequence: Synthetic oligonucleotide
cgugacagagaugugaaugg

SEQ ID NO: 1639 - RNA, 20 nt, Artificial Sequence
  Description of Artificial Sequence: Synthetic oligonucleotide
ggacgugacagagaugugaa

SEQ ID NO: 1640 - RNA, 20 nt, Artificial Sequence
  Description of Artificial Sequence: Synthetic oligonucleotide
uggacgugacagagauguga

SEQ ID NO: 1641 - RNA, 20 nt, Artificial Sequence
  Description of Artificial Sequence: Synthetic oligonucleotide
guggacgugacagagaugug

SEQ ID NO: 1642 - RNA, 20 nt, Artificial Sequence
  Description of Artificial Sequence: Synthetic oligonucleotide
aguggacgugacagagaugu

SEQ ID NO: 1643 - RNA, 20 nt, Artificial Sequence
  Description of Artificial Sequence: Synthetic oligonucleotide
uaguggacgugacagagaug

SEQ ID NO: 1644 - RNA, 20 nt, Artificial Sequence
  Description of Artificial Sequence: Synthetic oligonucleotide
uuaguggacgugacagagau

SEQ ID NO: 1645 - RNA, 20 nt, Artificial Sequence
  Description of Artificial Sequence: Synthetic oligonucleotide
auuaguggacgugacagaga

SEQ ID NO: 1646 - RNA, 20 nt, Artificial Sequence
  Description of Artificial Sequence: Synthetic oligonucleotide
gauuaguggacgugacagag

SEQ ID NO: 1647 - RNA, 20 nt, Artificial Sequence
  Description of Artificial Sequence: Synthetic oligonucleotide
cgauuaguggacgugacaga

SEQ ID NO: 1648 - RNA, 20 nt, Artificial Sequence
  Description of Artificial Sequence: Synthetic oligonucleotide
ccgauuaguggacgugacag

SEQ ID NO: 1649 - RNA, 20 nt, Artificial Sequence
  Description of Artificial Sequence: Synthetic oligonucleotide
ugccgauuaguggacgugac

SEQ ID NO: 1650 - RNA, 20 nt, Artificial Sequence
  Description of Artificial Sequence: Synthetic oligonucleotide
uugccgauuaguggacguga

SEQ ID NO: 1651 - RNA, 20 nt, Artificial Sequence
  Description of Artificial Sequence: Synthetic oligonucleotide
uuugccgauuaguggacgug

SEQ ID NO: 1652 - RNA, 20 nt, Artificial Sequence
  Description of Artificial Sequence: Synthetic oligonucleotide
uuuugccgauuaguggacgu

SEQ ID NO: 1653 - RNA, 20 nt, Artificial Sequence
  Description of Artificial Sequence: Synthetic oligonucleotide
cuuuugccgauuaguggacg

SEQ ID NO: 1654 - RNA, 20 nt, Artificial Sequence
  Description of Artificial Sequence: Synthetic oligonucleotide
ccuuuugccgauuaguggac

SEQ ID NO: 1655 - RNA, 20 nt, Artificial Sequence
  Description of Artificial Sequence: Synthetic oligonucleotide
uccuuuugccgauuagugga

SEQ ID NO: 1656 - RNA, 20 nt, Artificial Sequence
  Description of Artificial Sequence: Synthetic oligonucleotide
cuccuuuugccgauuagugg

SEQ ID NO: 1657 - RNA, 20 nt, Artificial Sequence
  Description of Artificial Sequence: Synthetic oligonucleotide
ucuccuuuugccgauuagug

SEQ ID NO: 1658 - RNA, 20 nt, Artificial Sequence
  Description of Artificial Sequence: Synthetic oligonucleotide
uucuccuuuugccgauuagu

SEQ ID NO: 1659 - RNA, 20 nt, Artificial Sequence
  Description of Artificial Sequence: Synthetic oligonucleotide
uuucuccuuuugccgauuag

SEQ ID NO: 1660 - RNA, 20 nt, Artificial Sequence
  Description of Artificial Sequence: Synthetic oligonucleotide
aggucaucuucucucacuuu

SEQ ID NO: 1661 - RNA, 20 nt, Artificial Sequence
  Description of Artificial Sequence: Synthetic oligonucleotide
uuaggucaucuucucucacu

SEQ ID NO: 1662 - RNA, 20 nt, Artificial Sequence
  Description of Artificial Sequence: Synthetic oligonucleotide
cuuaggucaucuucucucac

SEQ ID NO: 1663 - RNA, 20 nt, Artificial Sequence
  Description of Artificial Sequence: Synthetic oligonucleotide
acacuuaggucaucuucucu

SEQ ID NO: 1664 - RNA, 20 nt, Artificial Sequence
  Description of Artificial Sequence: Synthetic oligonucleotide
cacacuuaggucaucuucuc

SEQ ID NO: 1665 - RNA, 20 nt, Artificial Sequence
  Description of Artificial Sequence: Synthetic oligonucleotide
ucacacuuaggucaucuucu

SEQ ID NO: 1666 - RNA, 20 nt, Artificial Sequence
  Description of Artificial Sequence: Synthetic oligonucleotide
gucacacuuaggucaucuuc

SEQ ID NO: 1667 - RNA, 20 nt, Artificial Sequence
  Description of Artificial Sequence: Synthetic oligonucleotide
agucacacuuaggucaucuu

SEQ ID NO: 1668 - RNA, 20 nt, Artificial Sequence
  Description of Artificial Sequence: Synthetic oligonucleotide
cagucacacuuaggucaucu

SEQ ID NO: 1669 - RNA, 20 nt, Artificial Sequence
  Description of Artificial Sequence: Synthetic oligonucleotide
gcagucacacuuaggucauc

SEQ ID NO: 1670 - RNA, 20 nt, Artificial Sequence
  Description of Artificial Sequence: Synthetic oligonucleotide
ugcagucacacuuaggucau

SEQ ID NO: 1671 - RNA, 20 nt, Artificial Sequence
  Description of Artificial Sequence: Synthetic oligonucleotide
auuuuccagagcugccugcu

SEQ ID NO: 1672 - RNA, 20 nt, Artificial Sequence
  Description of Artificial Sequence: Synthetic oligonucleotide
cucacugcucuggcuucauu

SEQ ID NO: 1673 - RNA, 20 nt, Artificial Sequence
  Description of Artificial Sequence: Synthetic oligonucleotide
gcucacugcucuggcuucau

SEQ ID NO: 1674 - RNA, 20 nt, Artificial Sequence
  Description of Artificial Sequence: Synthetic oligonucleotide
uuaccugcucuuuccuuccu

SEQ ID NO: 1675 - RNA, 20 nt, Artificial Sequence
  Description of Artificial Sequence: Synthetic oligonucleotide
ugcuuaccugcucuuuccuu

SEQ ID NO: 1676 - RNA, 20 nt, Artificial Sequence
  Description of Artificial Sequence: Synthetic oligonucleotide
uuccugcuuaccugcucuuu

SEQ ID NO: 1677 - RNA, 20 nt, Artificial Sequence
  Description of Artificial Sequence: Synthetic oligonucleotide
cuuccugcuuaccugcucuu

SEQ ID NO: 1678 - RNA, 20 nt, Artificial Sequence
  Description of Artificial Sequence: Synthetic oligonucleotide
acuggccuuccugcuuaccu

SEQ ID NO: 1679 - RNA, 20 nt, Artificial Sequence
  Description of Artificial Sequence: Synthetic oligonucleotide
gacacuggccuuccugcuua

SEQ ID NO: 1680 - RNA, 20 nt, Artificial Sequence
  Description of Artificial Sequence: Synthetic oligonucleotide
cauuaggguccugucuggga

SEQ ID NO: 1681 - RNA, 20 nt, Artificial Sequence
  Description of Artificial Sequence: Synthetic oligonucleotide
ucauuaggguccugucuggg

SEQ ID NO: 1682 - RNA, 20 nt, Artificial Sequence
  Description of Artificial Sequence: Synthetic oligonucleotide
aucauuaggguccugucugg

SEQ ID NO: 1683 - RNA, 20 nt, Artificial Sequence
  Description of Artificial Sequence: Synthetic oligonucleotide
gaucauuaggguccugucug

SEQ ID NO: 1684 - RNA, 20 nt, Artificial Sequence
  Description of Artificial Sequence: Synthetic oligonucleotide
ggaucauuaggguccugucu

SEQ ID NO: 1685 - RNA, 20 nt, Artificial Sequence
  Description of Artificial Sequence: Synthetic oligonucleotide
auucaggaucauuagggucc

SEQ ID NO: 1686 - RNA, 20 nt, Artificial Sequence
  Description of Artificial Sequence: Synthetic oligonucleotide
gauucaggaucauuaggguc

SEQ ID NO: 1687 - RNA, 20 nt, Artificial Sequence
  Description of Artificial Sequence: Synthetic oligonucleotide
ggauucaggaucauuagggu

SEQ ID NO: 1688 - RNA, 20 nt, Artificial Sequence
  Description of Artificial Sequence: Synthetic oligonucleotide
auggauucaggaucauuagg

SEQ ID NO: 1689 - RNA, 20 nt, Artificial Sequence
  Description of Artificial Sequence: Synthetic oligonucleotide
gauacauggauucaggauca

SEQ ID NO: 1690 - RNA, 20 nt, Artificial Sequence
  Description of Artificial Sequence: Synthetic oligonucleotide
ugauacauggauucaggauc

SEQ ID NO: 1691 - RNA, 20 nt, Artificial Sequence
  Description of Artificial Sequence: Synthetic oligonucleotide
auggcagggcuuuggaaaau

SEQ ID NO: 1692 - RNA, 20 nt, Artificial Sequence
  Description of Artificial Sequence: Synthetic oligonucleotide
cauggcagggcuuuggaaaa

SEQ ID NO: 1693 - RNA, 20 nt, Artificial Sequence
  Description of Artificial Sequence: Synthetic oligonucleotide
gcauggcagggcuuuggaaa

SEQ ID NO: 1694 - RNA, 20 nt, Artificial Sequence
  Description of Artificial Sequence: Synthetic oligonucleotide
cagcauggcagggcuuugga

SEQ ID NO: 1695 - RNA, 20 nt, Artificial Sequence
  Description of Artificial Sequence: Synthetic oligonucleotide
gaagugggauggcagcaugg

SEQ ID NO: 1696 - RNA, 20 nt, Artificial Sequence
  Description of Artificial Sequence: Synthetic oligonucleotide
ggaagugggauggcagcaug

SEQ ID NO: 1697 - RNA, 20 nt, Artificial Sequence
  Description of Artificial Sequence: Synthetic oligonucleotide
gggaagugggauggcagcau

SEQ ID NO: 1698 - RNA, 20 nt, Artificial Sequence
  Description of Artificial Sequence: Synthetic oligonucleotide
uggagaagccauaagcugca

SEQ ID NO: 1699 - RNA, 20 nt, Artificial Sequence
  Description of Artificial Sequence: Synthetic oligonucleotide
cuggagaagccauaagcugc

SEQ ID NO: 1700 - RNA, 20 nt, Artificial Sequence
  Description of Artificial Sequence: Synthetic oligonucleotide
acuggagaagccauaagcug

SEQ ID NO: 1701 - RNA, 20 nt, Artificial Sequence
  Description of Artificial Sequence: Synthetic oligonucleotide
uacuggagaagccauaagcu

SEQ ID NO: 1702 - RNA, 20 nt, Artificial Sequence
  Description of Artificial Sequence: Synthetic oligonucleotide
cuacuggagaagccauaagc

SEQ ID NO: 1703 - RNA, 20 nt, Artificial Sequence
  Description of Artificial Sequence: Synthetic oligonucleotide
ccuacuggagaagccauaag

SEQ ID NO: 1704 - RNA, 20 nt, Artificial Sequence
  Description of Artificial Sequence: Synthetic oligonucleotide
accuacuggagaagccauaa

SEQ ID NO: 1705 - RNA, 20 nt, Artificial Sequence
  Description of Artificial Sequence: Synthetic oligonucleotide
caccuacuggagaagccaua

SEQ ID NO: 1706 - RNA, 20 nt, Artificial Sequence
  Description of Artificial Sequence: Synthetic oligonucleotide
ccaccuacuggagaagccau

SEQ ID NO: 1707 - RNA, 20 nt, Artificial Sequence
  Description of Artificial Sequence: Synthetic oligonucleotide
gccaccuacuggagaagcca

SEQ ID NO: 1708 - RNA, 20 nt, Artificial Sequence
  Description of Artificial Sequence: Synthetic oligonucleotide
cugccaccuacuggagaagc

SEQ ID NO: 1709 - RNA, 20 nt, Artificial Sequence
  Description of Artificial Sequence: Synthetic oligonucleotide
gcugccaccuacuggagaag

SEQ ID NO: 1710 - RNA, 20 nt, Artificial Sequence
  Description of Artificial Sequence: Synthetic oligonucleotide
ugugugugcugccaccuacu

SEQ ID NO: 1711 - RNA, 20 nt, Artificial Sequence
  Description of Artificial Sequence: Synthetic oligonucleotide
cugugugugcugccaccuac

SEQ ID NO: 1712 - RNA, 20 nt, Artificial Sequence
  Description of Artificial Sequence: Synthetic oligonucleotide
uuaugaguggcucugugugu

SEQ ID NO: 1713 - RNA, 20 nt, Artificial Sequence
  Description of Artificial Sequence: Synthetic oligonucleotide
uuuaugaguggcucugugug

SEQ ID NO: 1714 - RNA, 20 nt, Artificial Sequence
  Description of Artificial Sequence: Synthetic oligonucleotide
aguuuaugaguggcucugug

SEQ ID NO: 1715 - RNA, 20 nt, Artificial Sequence
  Description of Artificial Sequence: Synthetic oligonucleotide
caguuuaugaguggcucugu

SEQ ID NO: 1716 - RNA, 20 nt, Artificial Sequence
  Description of Artificial Sequence: Synthetic oligonucleotide
guuucuggcucucaggcucu

SEQ ID NO: 1717 - RNA, 20 nt, Artificial Sequence
  Description of Artificial Sequence: Synthetic oligonucleotide
gguuucuggcucucaggcuc

SEQ ID NO: 1718 - RNA, 20 nt, Artificial Sequence
  Description of Artificial Sequence: Synthetic oligonucleotide
cgguuucuggcucucaggcu

SEQ ID NO: 1719 - RNA, 20 nt, Artificial Sequence
  Description of Artificial Sequence: Synthetic oligonucleotide
ggacgguuucuggcucucag

SEQ ID NO: 1720 - RNA, 20 nt, Artificial Sequence
  Description of Artificial Sequence: Synthetic oligonucleotide
gggacgguuucuggcucuca

SEQ ID NO: 1721 - RNA, 20 nt, Artificial Sequence
  Description of Artificial Sequence: Synthetic oligonucleotide
ugaaaugugacuucuggugu

SEQ ID NO: 1722 - RNA, 20 nt, Artificial Sequence
  Description of Artificial Sequence: Synthetic oligonucleotide
gggaaccauguaaaaggaug

SEQ ID NO: 1723 - RNA, 20 nt, Artificial Sequence
  Description of Artificial Sequence: Synthetic oligonucleotide
gugaggguagaugggaacca

SEQ ID NO: 1724 - RNA, 20 nt, Artificial Sequence
  Description of Artificial Sequence: Synthetic oligonucleotide
uugugaggguagaugggaac

SEQ ID NO: 1725 - RNA, 20 nt, Artificial Sequence
  Description of Artificial Sequence: Synthetic oligonucleotide
guugugaggguagaugggaa

SEQ ID NO: 1726 - RNA, 20 nt, Artificial Sequence
  Description of Artificial Sequence: Synthetic oligonucleotide
uguugugaggguagauggga

SEQ ID NO: 1727 - RNA, 20 nt, Artificial Sequence
  Description of Artificial Sequence: Synthetic oligonucleotide
augugugucuuuggugauga

SEQ ID NO: 1728 - RNA, 20 nt, Artificial Sequence
  Description of Artificial Sequence: Synthetic oligonucleotide
ggagcuuguaugugugucuu

SEQ ID NO: 1729 - RNA, 20 nt, Artificial Sequence
  Description of Artificial Sequence: Synthetic oligonucleotide
uuggagcuuguauguguguc

SEQ ID NO: 1730 - RNA, 20 nt, Artificial Sequence
  Description of Artificial Sequence: Synthetic oligonucleotide
auuggagcuuguaugugugu

SEQ ID NO: 1731 - RNA, 20 nt, Artificial Sequence
  Description of Artificial Sequence: Synthetic oligonucleotide
cauuggagcuuguaugugug

SEQ ID NO: 1732 - RNA, 20 nt, Artificial Sequence
  Description of Artificial Sequence: Synthetic oligonucleotide
ccauuggagcuuguaugugu

SEQ ID NO: 1733 - RNA, 20 nt, Artificial Sequence
  Description of Artificial Sequence: Synthetic oligonucleotide
gccauuggagcuuguaugug

SEQ ID NO: 1734 - RNA, 20 nt, Artificial Sequence
  Description of Artificial Sequence: Synthetic oligonucleotide
agccauuggagcuuguaugu

SEQ ID NO: 1735 - RNA, 20 nt, Artificial Sequence
  Description of Artificial Sequence: Synthetic oligonucleotide
cuggaggaagaauugccugg

SEQ ID NO: 1736 - RNA, 20 nt, Artificial Sequence
  Description of Artificial Sequence: Synthetic oligonucleotide
guccuggaggaagaauugcc

SEQ ID NO: 1737 - RNA, 20 nt, Artificial Sequence
  Description of Artificial Sequence: Synthetic oligonucleotide
gccaguaagaagggcaaagu

SEQ ID NO: 1738 - RNA, 20 nt, Artificial Sequence
  Description of Artificial Sequence: Synthetic oligonucleotide
ggccaguaagaagggcaaag

SEQ ID NO: 1739 - RNA, 20 nt, Artificial Sequence
  Description of Artificial Sequence: Synthetic oligonucleotide
ggaaugagucaagccuggac

SEQ ID NO: 1740 - RNA, 20 nt, Artificial Sequence
  Description of Artificial Sequence: Synthetic oligonucleotide
gggaaugagucaagccugga

SEQ ID NO: 1741 - RNA, 20 nt, Artificial Sequence
  Description of Artificial Sequence: Synthetic oligonucleotide
gugggaaugagucaagccug

SEQ ID NO: 1742 - RNA, 20 nt, Artificial Sequence
  Description of Artificial Sequence: Synthetic oligonucleotide
aaggugggaaugagucaagc

SEQ ID NO: 1743 - RNA, 20 nt, Artificial Sequence
  Description of Artificial Sequence: Synthetic oligonucleotide
ucucagcccaggacaaggug

SEQ ID NO: 1744 - RNA, 20 nt, Artificial Sequence
  Description of Artificial Sequence: Synthetic oligonucleotide
aucucagcccaggacaaggu

SEQ ID NO: 1745 - RNA, 20 nt, Artificial Sequence
  Description of Artificial Sequence: Synthetic oligonucleotide
gcugggugguucucuccugu

SEQ ID NO: 1746 - RNA, 20 nt, Artificial Sequence
  Description of Artificial Sequence: Synthetic oligonucleotide
uucugggcugggugguucuc

SEQ ID NO: 1747 - RNA, 20 nt, Artificial Sequence
  Description of Artificial Sequence: Synthetic oligonucleotide
gaacuucugggcuggguggu

SEQ ID NO: 1748 - RNA, 20 nt, Artificial Sequence
  Description of Artificial Sequence: Synthetic oligonucleotide
cggagaguuccuucccugga

SEQ ID NO: 1749 - RNA, 20 nt, Artificial Sequence
  Description of Artificial Sequence: Synthetic oligonucleotide
accggagaguuccuucccug

SEQ ID NO: 1750 - RNA, 20 nt, Artificial Sequence
  Description of Artificial Sequence: Synthetic oligonucleotide
gaccggagaguuccuucccu

SEQ ID NO: 1751 - RNA, 20 nt, Artificial Sequence
  Description of Artificial Sequence: Synthetic oligonucleotide
uggaccggagaguuccuucc

SEQ ID NO: 1752 - RNA, 20 nt, Artificial Sequence
  Description of Artificial Sequence: Synthetic oligonucleotide
guggaccggagaguuccuuc

SEQ ID NO: 1753 - RNA, 20 nt, Artificial Sequence
  Description of Artificial Sequence: Synthetic oligonucleotide
gguggaccggagaguuccuu

SEQ ID NO: 1754 - RNA, 20 nt, Artificial Sequence
  Description of Artificial Sequence: Synthetic oligonucleotide
ugguggaccggagaguuccu

SEQ ID NO: 1755 - RNA, 20 nt, Artificial Sequence
  Description of Artificial Sequence: Synthetic oligonucleotide
augguggaccggagaguucc

SEQ ID NO: 1756 - RNA, 20 nt, Artificial Sequence
  Description of Artificial Sequence: Synthetic oligonucleotide
caugguggaccggagaguuc

SEQ ID NO: 1757 - RNA, 20 nt, Artificial Sequence
  Description of Artificial Sequence: Synthetic oligonucleotide
gagcugagagguacuccaug

SEQ ID NO: 1758 - RNA, 20 nt, Artificial Sequence
  Description of Artificial Sequence: Synthetic oligonucleotide
agagcugagagguacuccau

SEQ ID NO: 1759 - RNA, 20 nt, Artificial Sequence
  Description of Artificial Sequence: Synthetic oligonucleotide
cagagcugagagguacucca

SEQ ID NO: 1760 - RNA, 20 nt, Artificial Sequence
  Description of Artificial Sequence: Synthetic oligonucleotide
uucagagcugagagguacuc

SEQ ID NO: 1761 - RNA, 20 nt, Artificial Sequence
  Description of Artificial Sequence: Synthetic oligonucleotide
gguucagagcugagagguac

SEQ ID NO: 1762 - RNA, 20 nt, Artificial Sequence
  Description of Artificial Sequence: Synthetic oligonucleotide
ggguucagagcugagaggua

SEQ ID NO: 1763 - RNA, 20 nt, Artificial Sequence
  Description of Artificial Sequence: Synthetic oligonucleotide
caccugaguaagucacuggg

SEQ ID NO: 1764 - RNA, 20 nt, Artificial Sequence
  Description of Artificial Sequence: Synthetic oligonucleotide
ucaccugaguaagucacugg

SEQ ID NO: 1765 - RNA, 20 nt, Artificial Sequence
  Description of Artificial Sequence: Synthetic oligonucleotide
gucaccugaguaagucacug

SEQ ID NO: 1766 - RNA, 20 nt, Artificial Sequence
  Description of Artificial Sequence: Synthetic oligonucleotide
agucaccugaguaagucacu

SEQ ID NO: 1767 - RNA, 20 nt, Artificial Sequence
  Description of Artificial Sequence: Synthetic oligonucleotide
cagucaccugaguaagucac

SEQ ID NO: 1768 - RNA, 20 nt, Artificial Sequence
  Description of Artificial Sequence: Synthetic oligonucleotide
gcagucaccugaguaaguca

SEQ ID NO: 1769 - RNA, 20 nt, Artificial Sequence
  Description of Artificial Sequence: Synthetic oligonucleotide
uuagcagucaccugaguaag

SEQ ID NO: 1770 - RNA, 20 nt, Artificial Sequence
  Description of Artificial Sequence: Synthetic oligonucleotide
guuagcagucaccugaguaa

SEQ ID NO: 1771 - RNA, 20 nt, Artificial Sequence
  Description of Artificial Sequence: Synthetic oligonucleotide
gguuagcagucaccugagua

SEQ ID NO: 1772 - RNA, 20 nt, Artificial Sequence
  Description of Artificial Sequence: Synthetic oligonucleotide
ggguuagcagucaccugagu

SEQ ID NO: 1773 - RNA, 20 nt, Artificial Sequence
  Description of Artificial Sequence: Synthetic oligonucleotide
aggguuagcagucaccugag

SEQ ID NO: 1774 - RNA, 20 nt, Artificial Sequence
  Description of Artificial Sequence: Synthetic oligonucleotide
gaggguuagcagucaccuga

SEQ ID NO: 1775 - RNA, 20 nt, Artificial Sequence
  Description of Artificial Sequence: Synthetic oligonucleotide
ggaggguuagcagucaccug

SEQ ID NO: 1776 - RNA, 20 nt, Artificial Sequence
  Description of Artificial Sequence: Synthetic oligonucleotide
cggaggguuagcagucaccu

SEQ ID NO: 1777 - RNA, 20 nt, Artificial Sequence
  Description of Artificial Sequence: Synthetic oligonucleotide
agcggaggguuagcagucac

SEQ ID NO: 1778 - RNA, 20 nt, Artificial Sequence
  Description of Artificial Sequence: Synthetic oligonucleotide
gagcggaggguuagcaguca

SEQ ID NO: 1779 - RNA, 20 nt, Artificial Sequence
  Description of Artificial Sequence: Synthetic oligonucleotide
agagcggaggguuagcaguc

SEQ ID NO: 1780 - RNA, 20 nt, Artificial Sequence
  Description of Artificial Sequence: Synthetic oligonucleotide
uagagcggaggguuagcagu

SEQ ID NO: 1781 - RNA, 20 nt, Artificial Sequence
  Description of Artificial Sequence: Synthetic oligonucleotide
guagagcggaggguuagcag

SEQ ID NO: 1782 - RNA, 20 nt, Artificial Sequence
  Description of Artificial Sequence: Synthetic oligonucleotide
gguagagcggaggguuagca

SEQ ID NO: 1783 - RNA, 20 nt, Artificial Sequence
  Description of Artificial Sequence: Synthetic oligonucleotide
aggguagagcggaggguuag

SEQ ID NO: 1784 - RNA, 20 nt, Artificial Sequence
  Description of Artificial Sequence: Synthetic oligonucleotide
gaggguagagcggaggguua

SEQ ID NO: 1785 - RNA, 20 nt, Artificial Sequence
  Description of Artificial Sequence: Synthetic oligonucleotide
auuguugcccugccuauauc

SEQ ID NO: 1786 - RNA, 20 nt, Artificial Sequence
  Description of Artificial Sequence: Synthetic oligonucleotide
aguauuguugcccugccuau

SEQ ID NO: 1787 - RNA, 20 nt, Artificial Sequence
  Description of Artificial Sequence: Synthetic oligonucleotide
gaguauuguugcccugccua

SEQ ID NO: 1788 - RNA, 20 nt, Artificial Sequence
  Description of Artificial Sequence: Synthetic oligonucleotide
ggaguauuguugcccugccu

SEQ ID NO: 1789 - RNA, 20 nt, Artificial Sequence
  Description of Artificial Sequence: Synthetic oligonucleotide
uggaguauuguugcccugcc

SEQ ID NO: 1790 - RNA, 20 nt, Artificial Sequence
  Description of Artificial Sequence: Synthetic oligonucleotide
guggaguauuguugcccugc

SEQ ID NO: 1791 - RNA, 20 nt, Artificial Sequence
  Description of Artificial Sequence: Synthetic oligonucleotide
aguggaguauuguugcccug

SEQ ID NO: 1792 - RNA, 20 nt, Artificial Sequence
  Description of Artificial Sequence: Synthetic oligonucleotide
gaguggaguauuguugcccu

SEQ ID NO: 1793 - RNA, 20 nt, Artificial Sequence
  Description of Artificial Sequence: Synthetic oligonucleotide
ugaguggaguauuguugccc

SEQ ID NO: 1794 - RNA, 20 nt, Artificial Sequence
  Description of Artificial Sequence: Synthetic oligonucleotide
cugaguggaguauuguugcc

SEQ ID NO: 1795 - RNA, 20 nt, Artificial Sequence
  Description of Artificial Sequence: Synthetic oligonucleotide
gcugaguggaguauuguugc

SEQ ID NO: 1796 - RNA, 20 nt, Artificial Sequence
  Description of Artificial Sequence: Synthetic oligonucleotide
ggcugaguggaguauuguug

SEQ ID NO: 1797 - RNA, 20 nt, Artificial Sequence
  Description of Artificial Sequence: Synthetic oligonucleotide
gggcugaguggaguauuguu

SEQ ID NO: 1798 - RNA, 20 nt, Artificial Sequence
  Description of Artificial Sequence: Synthetic oligonucleotide
gguacugguuagucuccuag

SEQ ID NO: 1799 - RNA, 20 nt, Artificial Sequence
  Description of Artificial Sequence: Synthetic oligonucleotide
ggguacugguuagucuccua

SEQ ID NO: 1800 - RNA, 20 nt, Artificial Sequence
  Description of Artificial Sequence: Synthetic oligonucleotide
uugacaagcccacuguggag

SEQ ID NO: 1801 - RNA, 20 nt, Artificial Sequence
  Description of Artificial Sequence: Synthetic oligonucleotide
uggcucaggagcuugacaag

SEQ ID NO: 1802 - RNA, 20 nt, Artificial Sequence
  Description of Artificial Sequence: Synthetic oligonucleotide
gguggcucaggagcuugaca

SEQ ID NO: 1803 - RNA, 20 nt, Artificial Sequence
  Description of Artificial Sequence: Synthetic oligonucleotide
uagggaugagggagagacca

SEQ ID NO: 1804 - RNA, 20 nt, Artificial Sequence
  Description of Artificial Sequence: Synthetic oligonucleotide
ucgauuagggaugagggaga

SEQ ID NO: 1805 - RNA, 20 nt, Artificial Sequence
  Description of Artificial Sequence: Synthetic oligonucleotide
uagagggcuagggagggaga

SEQ ID NO: 1806 - RNA, 20 nt, Artificial Sequence
  Description of Artificial Sequence: Synthetic oligonucleotide
guagaguggcuagagggcua

SEQ ID NO: 1807 - RNA, 20 nt, Artificial Sequence
  Description of Artificial Sequence: Synthetic oligonucleotide
gguagaguggcuagagggcu

SEQ ID NO: 1808 - RNA, 20 nt, Artificial Sequence
  Description of Artificial Sequence: Synthetic oligonucleotide
ugaggguagaguggcuagag

SEQ ID NO: 1809 - RNA, 20 nt, Artificial Sequence
  Description of Artificial Sequence: Synthetic oligonucleotide
gaugaggguagaguggcuag

SEQ ID NO: 1810 - RNA, 20 nt, Artificial Sequence
  Description of Artificial Sequence: Synthetic oligonucleotide
caugaugaggguagaguggc

SEQ ID NO: 1811 - RNA, 20 nt, Artificial Sequence
  Description of Artificial Sequence: Synthetic oligonucleotide
gcaugaugaggguagagugg

SEQ ID NO: 1812 - RNA, 20 nt, Artificial Sequence
  Description of Artificial Sequence: Synthetic oligonucleotide
gggcaugaugaggguagagu

SEQ ID NO: 1813 - RNA, 20 nt, Artificial Sequence
  Description of Artificial Sequence: Synthetic oligonucleotide
gguaguugagaagaaaaguc

SEQ ID NO: 1814 - RNA, 20 nt, Artificial Sequence
  Description of Artificial Sequence: Synthetic oligonucleotide
ccaaacuccgagcuuauauu

SEQ ID NO: 1815 - RNA, 20 nt, Artificial Sequence
  Description of Artificial Sequence: Synthetic oligonucleotide
uccaaacuccgagcuuauau

SEQ ID NO: 1816 - RNA, 20 nt, Artificial Sequence
  Description of Artificial Sequence: Synthetic oligonucleotide
guccaaacuccgagcuuaua

SEQ ID NO: 1817 - RNA, 20 nt, Artificial Sequence
  Description of Artificial Sequence: Synthetic oligonucleotide
cguccaaacuccgagcuuau

SEQ ID NO: 1818 - RNA, 20 nt, Artificial Sequence
  Description of Artificial Sequence: Synthetic oligonucleotide
ccguccaaacuccgagcuua

SEQ ID NO: 1819 - RNA, 20 nt, Artificial Sequence
  Description of Artificial Sequence: Synthetic oligonucleotide
uccguccaaacuccgagcuu

SEQ ID NO: 1820 - RNA, 20 nt, Artificial Sequence
  Description of Artificial Sequence: Synthetic oligonucleotide
cuccguccaaacuccgagcu

SEQ ID NO: 1821 - RNA, 20 nt, Artificial Sequence
  Description of Artificial Sequence: Synthetic oligonucleotide
acccuccguccaaacuccga

SEQ ID NO: 1822 - RNA, 20 nt, Artificial Sequence
  Description of Artificial Sequence: Synthetic oligonucleotide
agacccuccguccaaacucc

SEQ ID NO: 1823 - RNA, 20 nt, Artificial Sequence
  Description of Artificial Sequence: Synthetic oligonucleotide
cagacccuccguccaaacuc

SEQ ID NO: 1824 - RNA, 20 nt, Artificial Sequence
  Description of Artificial Sequence: Synthetic oligonucleotide
uccagacccuccguccaaac

SEQ ID NO: 1825 - RNA, 20 nt, Artificial Sequence
  Description of Artificial Sequence: Synthetic oligonucleotide
guccagacccuccguccaaa

SEQ ID NO: 1826 - RNA, 20 nt, Artificial Sequence
  Description of Artificial Sequence: Synthetic oligonucleotide
agacacggaaaggucgcugg

SEQ ID NO: 1827 - RNA, 20 nt, Artificial Sequence
  Description of Artificial Sequence: Synthetic oligonucleotide
cagacacggaaaggucgcug

SEQ ID NO: 1828 - RNA, 20 nt, Artificial Sequence
  Description of Artificial Sequence: Synthetic oligonucleotide
acagacacggaaaggucgcu

SEQ ID NO: 1829 - RNA, 20 nt, Artificial Sequence
  Description of Artificial Sequence: Synthetic oligonucleotide
cacagacacggaaaggucgc

SEQ ID NO: 1830 - RNA, 20 nt, Artificial Sequence
  Description of Artificial Sequence: Synthetic oligonucleotide
ucacagacacggaaaggucg

SEQ ID NO: 1831 - RNA, 20 nt, Artificial Sequence
  Description of Artificial Sequence: Synthetic oligonucleotide
aucacagacacggaaagguc

SEQ ID NO: 1832 - RNA, 20 nt, Artificial Sequence
  Description of Artificial Sequence: Synthetic oligonucleotide
gaucacagacacggaaaggu

SEQ ID NO: 1833 - RNA, 20 nt, Artificial Sequence
  Description of Artificial Sequence: Synthetic oligonucleotide
uuggccuacuuacuuuggcu

SEQ ID NO: 1834 - RNA, 20 nt, Artificial Sequence
  Description of Artificial Sequence: Synthetic oligonucleotide
cuuggccuacuuacuuuggc

SEQ ID NO: 1835 - RNA, 20 nt, Artificial Sequence
  Description of Artificial Sequence: Synthetic oligonucleotide
acuuggccuacuuacuuugg

SEQ ID NO: 1836 - RNA, 20 nt, Artificial Sequence
  Description of Artificial Sequence: Synthetic oligonucleotide
gaggaacuuggccuacuuac

SEQ ID NO: 1837 - RNA, 20 nt, Artificial Sequence
  Description of Artificial Sequence: Synthetic oligonucleotide
cgaggaacuuggccuacuua

SEQ ID NO: 1838 - RNA, 20 nt, Artificial Sequence
  Description of Artificial Sequence: Synthetic oligonucleotide
ccgaggaacuuggccuacuu

SEQ ID NO: 1839 - RNA, 20 nt, Artificial Sequence
  Description of Artificial Sequence: Synthetic oligonucleotide
accgaggaacuuggccuacu

SEQ ID NO: 1840 - RNA, 20 nt, Artificial Sequence
  Description of Artificial Sequence: Synthetic oligonucleotide
aaccgaggaacuuggccuac

SEQ ID NO: 1841 - RNA, 20 nt, Artificial Sequence
  Description of Artificial Sequence: Synthetic oligonucleotide
gaaccgaggaacuuggccua

SEQ ID NO: 1842 - RNA, 20 nt, Artificial Sequence
  Description of Artificial Sequence: Synthetic oligonucleotide
ggaaccgaggaacuuggccu

SEQ ID NO: 1843 - RNA, 20 nt, Artificial Sequence
  Description of Artificial Sequence: Synthetic oligonucleotide
aggaaccgaggaacuuggcc

SEQ ID NO: 1844 - RNA, 20 nt, Artificial Sequence
  Description of Artificial Sequence: Synthetic oligonucleotide
uaggaaccgaggaacuuggc

SEQ ID NO: 1845 - RNA, 20 nt, Artificial Sequence
  Description of Artificial Sequence: Synthetic oligonucleotide
auaggaaccgaggaacuugg

SEQ ID NO: 1846 - RNA, 20 nt, Artificial Sequence
  Description of Artificial Sequence: Synthetic oligonucleotide
uauaggaaccgaggaacuug

SEQ ID NO: 1847 - RNA, 20 nt, Artificial Sequence
  Description of Artificial Sequence: Synthetic oligonucleotide
aucacaaguugccacuguug

SEQ ID NO: 1848 - RNA, 20 nt, Artificial Sequence
  Description of Artificial Sequence: Synthetic oligonucleotide
caucacaaguugccacuguu

SEQ ID NO: 1849 - RNA, 20 nt, Artificial Sequence
  Description of Artificial Sequence: Synthetic oligonucleotide
aucaucacaaguugccacug

SEQ ID NO: 1850 - RNA, 20 nt, Artificial Sequence
  Description of Artificial Sequence: Synthetic oligonucleotide
caucaucacaaguugccacu

SEQ ID NO: 1851 - RNA, 20 nt, Artificial Sequence
  Description of Artificial Sequence: Synthetic oligonucleotide
cugcuccaucaucacaaguu

SEQ ID NO: 1852 - RNA, 20 nt, Artificial Sequence
  Description of Artificial Sequence: Synthetic oligonucleotide
ucugcuccaucaucacaagu

SEQ ID NO: 1853 - RNA, 20 nt, Artificial Sequence
  Description of Artificial Sequence: Synthetic oligonucleotide
cccucugcuccaucaucaca

SEQ ID NO: 1854 - RNA, 20 nt, Artificial Sequence
  Description of Artificial Sequence: Synthetic oligonucleotide
ucagcccucugcuccaucau

SEQ ID NO: 1855 - RNA, 20 nt, Artificial Sequence
  Description of Artificial Sequence: Synthetic oligonucleotide
ugacuucagcccucugcucc

SEQ ID NO: 1856 - RNA, 20 nt, Artificial Sequence
  Description of Artificial Sequence: Synthetic oligonucleotide
gugacuucagcccucugcuc

SEQ ID NO: 1857 - RNA, 20 nt, Artificial Sequence
  Description of Artificial Sequence: Synthetic oligonucleotide
ugugacuucagcccucugcu

SEQ ID NO: 1858 - RNA, 20 nt, Artificial Sequence
  Description of Artificial Sequence: Synthetic oligonucleotide
gugugacuucagcccucugc

SEQ ID NO: 1859 - RNA, 20 nt, Artificial Sequence
  Description of Artificial Sequence: Synthetic oligonucleotide
ugugugacuucagcccucug

SEQ ID NO: 1860 - RNA, 20 nt, Artificial Sequence
  Description of Artificial Sequence: Synthetic oligonucleotide
gcccacuccgcugcuuuuag

SEQ ID NO: 1861 - RNA, 20 nt, Artificial Sequence
  Description of Artificial Sequence: Synthetic oligonucleotide
ggcccacuccgcugcuuuua

SEQ ID NO: 1862 - RNA, 20 nt, Artificial Sequence
  Description of Artificial Sequence: Synthetic oligonucleotide
aggcccacuccgcugcuuuu

SEQ ID NO: 1863 - RNA, 20 nt, Artificial Sequence
  Description of Artificial Sequence: Synthetic oligonucleotide
uaggcccacuccgcugcuuu

SEQ ID NO: 1864 - RNA, 20 nt, Artificial Sequence
  Description of Artificial Sequence: Synthetic oligonucleotide
uuaggcccacuccgcugcuu

SEQ ID NO: 1865 - RNA, 20 nt, Artificial Sequence
  Description of Artificial Sequence: Synthetic oligonucleotide
auuaggcccacuccgcugcu

SEQ ID NO: 1866 - RNA, 20 nt, Artificial Sequence
  Description of Artificial Sequence: Synthetic oligonucleotide
ucauuaggcccacuccgcug

SEQ ID NO: 1867 - RNA, 20 nt, Artificial Sequence
  Description of Artificial Sequence: Synthetic oligonucleotide
cucauuaggcccacuccgcu

SEQ ID NO: 1868 - RNA, 20 nt, Artificial Sequence
  Description of Artificial Sequence: Synthetic oligonucleotide
agcucauuaggcccacuccg

SEQ ID NO: 1869 - RNA, 20 nt, Artificial Sequence
  Description of Artificial Sequence: Synthetic oligonucleotide
cucccauagaaaagcucacu

SEQ ID NO: 1870 - RNA, 20 nt, Artificial Sequence
  Description of Artificial Sequence: Synthetic oligonucleotide
gcucccauagaaaagcucac

SEQ ID NO: 1871 - RNA, 20 nt, Artificial Sequence
  Description of Artificial Sequence: Synthetic oligonucleotide
ugcucccauagaaaagcuca

SEQ ID NO: 1872 - RNA, 20 nt, Artificial Sequence
  Description of Artificial Sequence: Synthetic oligonucleotide
cugcucccauagaaaagcuc

SEQ ID NO: 1873 - RNA, 20 nt, Artificial Sequence
  Description of Artificial Sequence: Synthetic oligonucleotide
ccugcucccauagaaaagcu

SEQ ID NO: 1874 - RNA, 20 nt, Artificial Sequence
  Description of Artificial Sequence: Synthetic oligonucleotide
ucccuaucuccugcuaaccc

SEQ ID NO: 1875 - RNA, 20 nt, Artificial Sequence
  Description of Artificial Sequence: Synthetic oligonucleotide
ccucgaacucucccuaucuc

SEQ ID NO: 1876 - RNA, 20 nt, Artificial Sequence
  Description of Artificial Sequence: Synthetic oligonucleotide
cccucgaacucucccuaucu

SEQ ID NO: 1877 - RNA, 20 nt, Artificial Sequence
  Description of Artificial Sequence: Synthetic oligonucleotide
ucccucgaacucucccuauc

SEQ ID NO: 1878 - RNA, 20 nt, Artificial Sequence
  Description of Artificial Sequence: Synthetic oligonucleotide
gucccucgaacucucccuau

SEQ ID NO: 1879 - RNA, 20 nt, Artificial Sequence
  Description of Artificial Sequence: Synthetic oligonucleotide
cuuuccauacuagcuucuga

SEQ ID NO: 1880 - RNA, 20 nt, Artificial Sequence
  Description of Artificial Sequence: Synthetic oligonucleotide
ccuuuccauacuagcuucug

SEQ ID NO: 1881 - RNA, 20 nt, Artificial Sequence
  Description of Artificial Sequence: Synthetic oligonucleotide
accuuuccauacuagcuucu

SEQ ID NO: 1882 - RNA, 20 nt, Artificial Sequence
  Description of Artificial Sequence: Synthetic oligonucleotide
cacacaaaucaccuuuccau

SEQ ID NO: 1883 - RNA, 20 nt, Artificial Sequence
  Description of Artificial Sequence: Synthetic oligonucleotide
gucacacaaaucaccuuucc

SEQ ID NO: 1884 - RNA, 20 nt, Artificial Sequence
  Description of Artificial Sequence: Synthetic oligonucleotide
ugucacacaaaucaccuuuc

SEQ ID NO: 1885 - RNA, 20 nt, Artificial Sequence
  Description of Artificial Sequence: Synthetic oligonucleotide
uuugacaggcaggaaguggc

SEQ ID NO: 1886 - RNA, 20 nt, Artificial Sequence
  Description of Artificial Sequence: Synthetic oligonucleotide
gguuugacaggcaggaagug

SEQ ID NO: 1887 - RNA, 20 nt, Artificial Sequence
  Description of Artificial Sequence: Synthetic oligonucleotide
agguuugacaggcaggaagu

SEQ ID NO: 1888 - RNA, 20 nt, Artificial Sequence
  Description of Artificial Sequence: Synthetic oligonucleotide
aagguuugacaggcaggaag

SEQ ID NO: 1889 - RNA, 20 nt, Artificial Sequence
  Description of Artificial Sequence: Synthetic oligonucleotide
aacuucccaagguuugacag

SEQ ID NO: 1890 - RNA, 20 nt, Artificial Sequence
  Description of Artificial Sequence: Synthetic oligonucleotide
caacuucccaagguuugaca

SEQ ID NO: 1891 - RNA, 20 nt, Artificial Sequence
  Description of Artificial Sequence: Synthetic oligonucleotide
gaacaacuucccaagguuug

SEQ ID NO: 1892 - RNA, 20 nt, Artificial Sequence
  Description of Artificial Sequence: Synthetic oligonucleotide
ugaacaacuucccaagguuu

SEQ ID NO: 1893 - RNA, 20 nt, Artificial Sequence
  Description of Artificial Sequence: Synthetic oligonucleotide
guagguugaacaacuuccca

SEQ ID NO: 1894 - RNA, 20 nt, Artificial Sequence
  Description of Artificial Sequence: Synthetic oligonucleotide
gguagguugaacaacuuccc

SEQ ID NO: 1895 - RNA, 20 nt, Artificial Sequence
  Description of Artificial Sequence: Synthetic oligonucleotide
ugguagguugaacaacuucc

SEQ ID NO: 1896 - RNA, 20 nt, Artificial Sequence
  Description of Artificial Sequence: Synthetic oligonucleotide
gguuuugguagguugaacaa

SEQ ID NO: 1897 - RNA, 20 nt, Artificial Sequence
  Description of Artificial Sequence: Synthetic oligonucleotide
ugagguuuugguagguugaa

SEQ ID NO: 1898 - RNA, 20 nt, Artificial Sequence
  Description of Artificial Sequence: Synthetic oligonucleotide
cugagguuuugguagguuga

SEQ ID NO: 1899 - RNA, 20 nt, Artificial Sequence
  Description of Artificial Sequence: Synthetic oligonucleotide
ccuacauuauccucuuacuc

SEQ ID NO: 1900 - RNA, 20 nt, Artificial Sequence
  Description of Artificial Sequence: Synthetic oligonucleotide
ggacuuuaccuacauuaucc

SEQ ID NO: 1901 - RNA, 20 nt, Artificial Sequence
  Description of Artificial Sequence: Synthetic oligonucleotide
guaugaggacuuuaccuaca

SEQ ID NO: 1902 - RNA, 20 nt, Artificial Sequence
  Description of Artificial Sequence: Synthetic oligonucleotide
gccagguaugaggacuuuac

SEQ ID NO: 1903 - RNA, 20 nt, Artificial Sequence
  Description of Artificial Sequence: Synthetic oligonucleotide
ugccagguaugaggacuuua

SEQ ID NO: 1904 - RNA, 20 nt, Artificial Sequence
  Description of Artificial Sequence: Synthetic oligonucleotide
gugccagguaugaggacuuu

SEQ ID NO: 1905 - RNA, 20 nt, Artificial Sequence
  Description of Artificial Sequence: Synthetic oligonucleotide
cugugccagguaugaggacu

SEQ ID NO: 1906 - RNA, 20 nt, Artificial Sequence
  Description of Artificial Sequence: Synthetic oligonucleotide
ucugugccagguaugaggac

SEQ ID NO: 1907 - RNA, 20 nt, Artificial Sequence
  Description of Artificial Sequence: Synthetic oligonucleotide
ccucaagaguucuccagaag

SEQ ID NO: 1908 - RNA, 20 nt, Artificial Sequence
  Description of Artificial Sequence: Synthetic oligonucleotide
cccucaagaguucuccagaa

SEQ ID NO: 1909 - RNA, 20 nt, Artificial Sequence
  Description of Artificial Sequence: Synthetic oligonucleotide
acccucaagaguucuccaga

SEQ ID NO: 1910 - RNA, 20 nt, Artificial Sequence
  Description of Artificial Sequence: Synthetic oligonucleotide
acacccucaagaguucucca

SEQ ID NO: 1911 - RNA, 20 nt, Artificial Sequence
  Description of Artificial Sequence: Synthetic oligonucleotide
cacacccucaagaguucucc

SEQ ID NO: 1912 - RNA, 20 nt, Artificial Sequence
  Description of Artificial Sequence: Synthetic oligonucleotide
ccacacccucaagaguucuc

SEQ ID NO: 1913 - RNA, 20 nt, Artificial Sequence
  Description of Artificial Sequence: Synthetic oligonucleotide
cccacacccucaagaguucu

SEQ ID NO: 1914 - RNA, 20 nt, Artificial Sequence
  Description of Artificial Sequence: Synthetic oligonucleotide
uucccacacccucaagaguu

SEQ ID NO: 1915 - RNA, 20 nt, Artificial Sequence
  Description of Artificial Sequence: Synthetic oligonucleotide
caaugcugcaccucacuucc

SEQ ID NO: 1916 - RNA, 20 nt, Artificial Sequence
  Description of Artificial Sequence: Synthetic oligonucleotide
uacaaugcugcaccucacuu

SEQ ID NO: 1917 - RNA, 20 nt, Artificial Sequence
  Description of Artificial Sequence: Synthetic oligonucleotide
cuacaaugcugcaccucacu

SEQ ID NO: 1918 - RNA, 20 nt, Artificial Sequence
  Description of Artificial Sequence: Synthetic oligonucleotide
ucuacaaugcugcaccucac

SEQ ID NO: 1919 - RNA, 20 nt, Artificial Sequence
  Description of Artificial Sequence: Synthetic oligonucleotide
aucuacaaugcugcaccuca

SEQ ID NO: 1920 - RNA, 20 nt, Artificial Sequence
  Description of Artificial Sequence: Synthetic oligonucleotide
uaucuacaaugcugcaccuc

SEQ ID NO: 1921 - RNA, 20 nt, Artificial Sequence
  Description of Artificial Sequence: Synthetic oligonucleotide
cuuaucuacaaugcugcacc

SEQ ID NO: 1922 - RNA, 20 nt, Artificial Sequence
  Description of Artificial Sequence: Synthetic oligonucleotide
gucuuaucuacaaugcugca

SEQ ID NO: 1923 - RNA, 20 nt, Artificial Sequence
  Description of Artificial Sequence: Synthetic oligonucleotide
ugucuuaucuacaaugcugc

SEQ ID NO: 1924 - RNA, 20 nt, Artificial Sequence
  Description of Artificial Sequence: Synthetic oligonucleotide
cugucuuaucuacaaugcug

SEQ ID NO: 1925 - RNA, 20 nt, Artificial Sequence
  Description of Artificial Sequence: Synthetic oligonucleotide
cacccuucugucuuaucuac

SEQ ID NO: 1926 - RNA, 20 nt, Artificial Sequence
  Description of Artificial Sequence: Synthetic oligonucleotide
uccacccuucugucuuaucu

SEQ ID NO: 1927 - RNA, 20 nt, Artificial Sequence
  Description of Artificial Sequence: Synthetic oligonucleotide
guccacccuucugucuuauc

SEQ ID NO: 1928 - RNA, 20 nt, Artificial Sequence
  Description of Artificial Sequence: Synthetic oligonucleotide
aguccacccuucugucuuau

SEQ ID NO: 1929 - RNA, 20 nt, Artificial Sequence
  Description of Artificial Sequence: Synthetic oligonucleotide
aaguccacccuucugucuua

SEQ ID NO: 1930 - RNA, 20 nt, Artificial Sequence
  Description of Artificial Sequence: Synthetic oligonucleotide
gaaagcaagccagguucuca

SEQ ID NO: 1931 - RNA, 20 nt, Artificial Sequence
  Description of Artificial Sequence: Synthetic oligonucleotide
ggaaagcaagccagguucuc

SEQ ID NO: 1932 - RNA, 20 nt, Artificial Sequence
  Description of Artificial Sequence: Synthetic oligonucleotide
ggaauuggaaagcaagccag

SEQ ID NO: 1933 - RNA, 20 nt, Artificial Sequence
  Description of Artificial Sequence: Synthetic oligonucleotide
accaugucauuggcaucucc

SEQ ID NO: 1934 - RNA, 20 nt, Artificial Sequence
  Description of Artificial Sequence: Synthetic oligonucleotide
uaccaugucauuggcaucuc

SEQ ID NO: 1935 - RNA, 20 nt, Artificial Sequence
  Description of Artificial Sequence: Synthetic oligonucleotide
ccuaccaugucauuggcauc

SEQ ID NO: 1936 - RNA, 20 nt, Artificial Sequence
  Description of Artificial Sequence: Synthetic oligonucleotide
uccuaccaugucauuggcau

SEQ ID NO: 1937 - RNA, 20 nt, Artificial Sequence
  Description of Artificial Sequence: Synthetic oligonucleotide
cuccuaccaugucauuggca

SEQ ID NO: 1938 - RNA, 20 nt, Artificial Sequence
  Description of Artificial Sequence: Synthetic oligonucleotide
gcuccuaccaugucauuggc

SEQ ID NO: 1939 - RNA, 20 nt, Artificial Sequence
  Description of Artificial Sequence: Synthetic oligonucleotide
ugcuccuaccaugucauugg

SEQ ID NO: 1940 - RNA, 20 nt, Artificial Sequence
  Description of Artificial Sequence: Synthetic oligonucleotide
ucuuugcuccuaccauguca

SEQ ID NO: 1941 - RNA, 20 nt, Artificial Sequence
  Description of Artificial Sequence: Synthetic oligonucleotide
ccucuuugcuccuaccaugu

SEQ ID NO: 1942 - RNA, 20 nt, Artificial Sequence
  Description of Artificial Sequence: Synthetic oligonucleotide
uuccucuuugcuccuaccau

SEQ ID NO: 1943 - RNA, 20 nt, Artificial Sequence
  Description of Artificial Sequence: Synthetic oligonucleotide
ucuccguguucuucaguuuu

SEQ ID NO: 1944 - RNA, 20 nt, Artificial Sequence
  Description of Artificial Sequence: Synthetic oligonucleotide
cucuccguguucuucaguuu

SEQ ID NO: 1945 - RNA, 20 nt, Artificial Sequence
  Description of Artificial Sequence: Synthetic oligonucleotide
agcucuccguguucuucagu

SEQ ID NO: 1946 - RNA, 20 nt, Artificial Sequence
  Description of Artificial Sequence: Synthetic oligonucleotide
ugcagcucuccguguucuuc

SEQ ID NO: 1947 - RNA, 20 nt, Artificial Sequence
  Description of Artificial Sequence: Synthetic oligonucleotide
gguugcagcucuccguguuc

SEQ ID NO: 1948 - RNA, 20 nt, Artificial Sequence
  Description of Artificial Sequence: Synthetic oligonucleotide
agguugcagcucuccguguu

SEQ ID NO: 1949 - RNA, 20 nt, Artificial Sequence
  Description of Artificial Sequence: Synthetic oligonucleotide
aaagguugcagcucuccgug

SEQ ID NO: 1950 - RNA, 20 nt, Artificial Sequence
  Description of Artificial Sequence: Synthetic oligonucleotide
uaaagguugcagcucuccgu

SEQ ID NO: 1951 - RNA, 20 nt, Artificial Sequence
  Description of Artificial Sequence: Synthetic oligonucleotide
cuaaagguugcagcucuccg

SEQ ID NO: 1952 - RNA, 20 nt, Artificial Sequence
  Description of Artificial Sequence: Synthetic oligonucleotide
ccuaaagguugcagcucucc

SEQ ID NO: 1953 - RNA, 20 nt, Artificial Sequence
  Description of Artificial Sequence: Synthetic oligonucleotide
uccuaaagguugcagcucuc

SEQ ID NO: 1954 - RNA, 20 nt, Artificial Sequence
  Description of Artificial Sequence: Synthetic oligonucleotide
cuccuaaagguugcagcucu

SEQ ID NO: 1955 - RNA, 20 nt, Artificial Sequence
  Description of Artificial Sequence: Synthetic oligonucleotide
ccuccuaaagguugcagcuc

SEQ ID NO: 1956 - RNA, 20 nt, Artificial Sequence
  Description of Artificial Sequence: Synthetic oligonucleotide
gcacuuugauaccuccuaaa

SEQ ID NO: 1957 - RNA, 20 nt, Artificial Sequence
  Description of Artificial Sequence: Synthetic oligonucleotide
ggcacuuugauaccuccuaa

SEQ ID NO: 1958 - RNA, 20 nt, Artificial Sequence
  Description of Artificial Sequence: Synthetic oligonucleotide
gaugucccacuuugacuuuc

SEQ ID NO: 1959 - RNA, 20 nt, Artificial Sequence
  Description of Artificial Sequence: Synthetic oligonucleotide
ucgaugucccacuuugacuu

SEQ ID NO: 1960 - RNA, 20 nt, Artificial Sequence
  Description of Artificial Sequence: Synthetic oligonucleotide
gucgaugucccacuuugacu

SEQ ID NO: 1961 - RNA, 20 nt, Artificial Sequence
  Description of Artificial Sequence: Synthetic oligonucleotide
ggucgaugucccacuuugac

SEQ ID NO: 1962 - RNA, 20 nt, Artificial Sequence
  Description of Artificial Sequence: Synthetic oligonucleotide
uggucgaugucccacuuuga

SEQ ID NO: 1963 - RNA, 20 nt, Artificial Sequence
  Description of Artificial Sequence: Synthetic oligonucleotide
uuggucgaugucccacuuug

SEQ ID NO: 1964 - RNA, 20 nt, Artificial Sequence
  Description of Artificial Sequence: Synthetic oligonucleotide
auuggucgaugucccacuuu

SEQ ID NO: 1965 - RNA, 20 nt, Artificial Sequence
  Description of Artificial Sequence: Synthetic oligonucleotide
cauuggucgaugucccacuu

SEQ ID NO: 1966 - RNA, 20 nt, Artificial Sequence
  Description of Artificial Sequence: Synthetic oligonucleotide
aacauccaucaguuggcucu

SEQ ID NO: 1967 - RNA, 20 nt, Artificial Sequence
  Description of Artificial Sequence: Synthetic oligonucleotide
cugcccaacauccaucaguu

SEQ ID NO: 1968 - RNA, 20 nt, Artificial Sequence
  Description of Artificial Sequence: Synthetic oligonucleotide
agcugcccaacauccaucag

SEQ ID NO: 1969 - RNA, 20 nt, Artificial Sequence
  Description of Artificial Sequence: Synthetic oligonucleotide
uagcugcccaacauccauca

SEQ ID NO: 1970 - RNA, 20 nt, Artificial Sequence
  Description of Artificial Sequence: Synthetic oligonucleotide
uuagcugcccaacauccauc

SEQ ID NO: 1971 - RNA, 20 nt, Artificial Sequence
  Description of Artificial Sequence: Synthetic oligonucleotide
uuuagcugcccaacauccau

SEQ ID NO: 1972 - RNA, 20 nt, Artificial Sequence
  Description of Artificial Sequence: Synthetic oligonucleotide
cuuuagcugcccaacaucca

SEQ ID NO: 1973 - RNA, 20 nt, Artificial Sequence
  Description of Artificial Sequence: Synthetic oligonucleotide
ccucuuuagcugcccaacau

SEQ ID NO: 1974 - RNA, 20 nt, Artificial Sequence
  Description of Artificial Sequence: Synthetic oligonucleotide
cccucuuuagcugcccaaca

SEQ ID NO: 1975 - RNA, 20 nt, Artificial Sequence
  Description of Artificial Sequence: Synthetic oligonucleotide
ucccucuuuagcugcccaac

SEQ ID NO: 1976 - RNA, 20 nt, Artificial Sequence
  Description of Artificial Sequence: Synthetic oligonucleotide
uucccucuuuagcugcccaa

SEQ ID NO: 1977 - RNA, 20 nt, Artificial Sequence
  Description of Artificial Sequence: Synthetic oligonucleotide
ccuucccucuuuagcugccc

SEQ ID NO: 1978 - RNA, 20 nt, Artificial Sequence
  Description of Artificial Sequence: Synthetic oligonucleotide
cccuucccucuuuagcugcc

SEQ ID NO: 1979 - RNA, 20 nt, Artificial Sequence
  Description of Artificial Sequence: Synthetic oligonucleotide
gcaggucuuaucccaugccc

SEQ ID NO: 1980 - RNA, 20 nt, Artificial Sequence
  Description of Artificial Sequence: Synthetic oligonucleotide
gggcaggucuuaucccaugc

SEQ ID NO: 1981 - RNA, 20 nt, Artificial Sequence
  Description of Artificial Sequence: Synthetic oligonucleotide
agggcaggucuuaucccaug

SEQ ID NO: 1982 - RNA, 20 nt, Artificial Sequence
  Description of Artificial Sequence: Synthetic oligonucleotide
aagggcaggucuuaucccau

SEQ ID NO: 1983 - RNA, 20 nt, Artificial Sequence
  Description of Artificial Sequence: Synthetic oligonucleotide
gaagggcaggucuuauccca

SEQ ID NO: 1984 - RNA, 20 nt, Artificial Sequence
  Description of Artificial Sequence: Synthetic oligonucleotide
agaagggcaggucuuauccc

SEQ ID NO: 1985 - RNA, 20 nt, Artificial Sequence
  Description of Artificial Sequence: Synthetic oligonucleotide
ccaauggcaagaagcaagaa

SEQ ID NO: 1986 - RNA, 20 nt, Artificial Sequence
  Description of Artificial Sequence: Synthetic oligonucleotide
cccaauggcaagaagcaaga

SEQ ID NO: 1987 - RNA, 20 nt, Artificial Sequence
  Description of Artificial Sequence: Synthetic oligonucleotide
gcccaauggcaagaagcaag

SEQ ID NO: 1988 - RNA, 20 nt, Artificial Sequence
  Description of Artificial Sequence: Synthetic oligonucleotide
uccaaugccugcccaauggc

SEQ ID NO: 1989 - RNA, 20 nt, Artificial Sequence
  Description of Artificial Sequence: Synthetic oligonucleotide
cuccaaugccugcccaaugg

SEQ ID NO: 1990 - RNA, 20 nt, Artificial Sequence
  Description of Artificial Sequence: Synthetic oligonucleotide
ucuccaaugccugcccaaug

SEQ ID NO: 1991 - RNA, 20 nt, Artificial Sequence
  Description of Artificial Sequence: Synthetic oligonucleotide
ggucuccaaugccugcccaa

SEQ ID NO: 1992 - RNA, 20 nt, Artificial Sequence
  Description of Artificial Sequence: Synthetic oligonucleotide
uagggucuccaaugccugcc

SEQ ID NO: 1993 - RNA, 20 nt, Artificial Sequence
  Description of Artificial Sequence: Synthetic oligonucleotide
guagggucuccaaugccugc

SEQ ID NO: 1994 - RNA, 20 nt, Artificial Sequence
  Description of Artificial Sequence: Synthetic oligonucleotide
aguagggucuccaaugccug

SEQ ID NO: 1995 - RNA, 20 nt, Artificial Sequence
  Description of Artificial Sequence: Synthetic oligonucleotide
caguagggucuccaaugccu

SEQ ID NO: 1996 - RNA, 20 nt, Artificial Sequence
  Description of Artificial Sequence: Synthetic oligonucleotide
gcaguagggucuccaaugcc

SEQ ID NO: 1997 - RNA, 20 nt, Artificial Sequence
  Description of Artificial Sequence: Synthetic oligonucleotide
agcaguagggucuccaaugc

SEQ ID NO: 1998 - RNA, 20 nt, Artificial Sequence
  Description of Artificial Sequence: Synthetic oligonucleotide
cagcaguagggucuccaaug

SEQ ID NO: 1999 - RNA, 20 nt, Artificial Sequence
  Description of Artificial Sequence: Synthetic oligonucleotide
ucagcaguagggucuccaau

SEQ ID NO: 2000 - RNA, 20 nt, Artificial Sequence
  Description of Artificial Sequence: Synthetic oligonucleotide
auucagcaguagggucucca

SEQ ID NO: 2001 - RNA, 20 nt, Artificial Sequence
  Description of Artificial Sequence: Synthetic oligonucleotide
cauucagcaguagggucucc

SEQ ID NO: 2002 - RNA, 20 nt, Artificial Sequence
  Description of Artificial Sequence: Synthetic oligonucleotide
ccauucagcaguagggucuc

SEQ ID NO: 2003 - RNA, 20 nt, Artificial Sequence
  Description of Artificial Sequence: Synthetic oligonucleotide
uccauucagcaguagggucu

SEQ ID NO: 2004 - RNA, 20 nt, Artificial Sequence
  Description of Artificial Sequence: Synthetic oligonucleotide
acuccauucagcaguagggu

SEQ ID NO: 2005 - RNA, 20 nt, Artificial Sequence
  Description of Artificial Sequence: Synthetic oligonucleotide
cacuccauucagcaguaggg

SEQ ID NO: 2006 - RNA, 20 nt, Artificial Sequence
  Description of Artificial Sequence: Synthetic oligonucleotide
gcacuccauucagcaguagg

SEQ ID NO: 2007 - RNA, 20 nt, Artificial Sequence
  Description of Artificial Sequence: Synthetic oligonucleotide
agcacuccauucagcaguag

SEQ ID NO: 2008 - RNA, 20 nt, Artificial Sequence
  Description of Artificial Sequence: Synthetic oligonucleotide
uagcacuccauucagcagua

SEQ ID NO: 2009 - RNA, 20 nt, Artificial Sequence
  Description of Artificial Sequence: Synthetic oligonucleotide
guuagcacuccauucagcag

SEQ ID NO: 2010 - RNA, 20 nt, Artificial Sequence
  Description of Artificial Sequence: Synthetic oligonucleotide
gguuagcacuccauucagca

SEQ ID NO: 2011 - RNA, 20 nt, Artificial Sequence
  Description of Artificial Sequence: Synthetic oligonucleotide
ggguuagcacuccauucagc

SEQ ID NO: 2012 - RNA, 20 nt, Artificial Sequence
  Description of Artificial Sequence: Synthetic oligonucleotide
caggguuagcacuccauuca

SEQ ID NO: 2013 - RNA, 20 nt, Artificial Sequence
  Description of Artificial Sequence: Synthetic oligonucleotide
ccaggguuagcacuccauuc

SEQ ID NO: 2014 - RNA, 20 nt, Artificial Sequence
  Description of Artificial Sequence: Synthetic oligonucleotide
accaggguuagcacuccauu

SEQ ID NO: 2015 - RNA, 20 nt, Artificial Sequence
  Description of Artificial Sequence: Synthetic oligonucleotide
caccaggguuagcacuccau

SEQ ID NO: 2016 - RNA, 20 nt, Artificial Sequence
  Description of Artificial Sequence: Synthetic oligonucleotide
gcaccaggguuagcacucca

SEQ ID NO: 2017 - RNA, 20 nt, Artificial Sequence
  Description of Artificial Sequence: Synthetic oligonucleotide
agcaccaggguuagcacucc

SEQ ID NO: 2018 - RNA, 20 nt, Artificial Sequence
  Description of Artificial Sequence: Synthetic oligonucleotide
uagcaccaggguuagcacuc

SEQ ID NO: 2019 - RNA, 20 nt, Artificial Sequence
  Description of Artificial Sequence: Synthetic oligonucleotide
cuagcaccaggguuagcacu

SEQ ID NO: 2020 - RNA, 20 nt, Artificial Sequence
  Description of Artificial Sequence: Synthetic oligonucleotide
ucuagcaccaggguuagcac

SEQ ID NO: 2021 - RNA, 20 nt, Artificial Sequence
  Description of Artificial Sequence: Synthetic oligonucleotide
cucuagcaccaggguuagca

SEQ ID NO: 2022 - RNA, 20 nt, Artificial Sequence
  Description of Artificial Sequence: Synthetic oligonucleotide
ccucuagcaccaggguuagc

SEQ ID NO: 2023 - RNA, 20 nt, Artificial Sequence
  Description of Artificial Sequence: Synthetic oligonucleotide
uccucuagcaccaggguuag

SEQ ID NO: 2024 - RNA, 20 nt, Artificial Sequence
  Description of Artificial Sequence: Synthetic oligonucleotide
cuccucuagcaccaggguua

SEQ ID NO: 2025 - RNA, 20 nt, Artificial Sequence
  Description of Artificial Sequence: Synthetic oligonucleotide
ccuccucuagcaccaggguu

SEQ ID NO: 2026 - RNA, 20 nt, Artificial Sequence
  Description of Artificial Sequence: Synthetic oligonucleotide
uccuccucuagcaccagggu

SEQ ID NO: 2027 - RNA, 20 nt, Artificial Sequence
  Description of Artificial Sequence: Synthetic oligonucleotide
guuccauccuccucuagcac

SEQ ID NO: 2028 - RNA, 20 nt, Artificial Sequence
  Description of Artificial Sequence: Synthetic oligonucleotide
aaguccucacuguccacugc

SEQ ID NO: 2029 - RNA, 20 nt, Artificial Sequence
  Description of Artificial Sequence: Synthetic oligonucleotide
gaaguccucacuguccacug

SEQ ID NO: 2030 - RNA, 20 nt, Artificial Sequence
  Description of Artificial Sequence: Synthetic oligonucleotide
agaaguccucacuguccacu

SEQ ID NO: 2031 - RNA, 20 nt, Artificial Sequence
  Description of Artificial Sequence: Synthetic oligonucleotide
aagaaguccucacuguccac

SEQ ID NO: 2032 - RNA, 20 nt, Artificial Sequence
  Description of Artificial Sequence: Synthetic oligonucleotide
gaagaaguccucacugucca

SEQ ID NO: 2033 - RNA, 20 nt, Artificial Sequence
  Description of Artificial Sequence: Synthetic oligonucleotide
ggaagaaguccucacugucc

SEQ ID NO: 2034 - RNA, 20 nt, Artificial Sequence
  Description of Artificial Sequence: Synthetic oligonucleotide
uggaagaaguccucacuguc

SEQ ID NO: 2035 - RNA, 20 nt, Artificial Sequence
  Description of Artificial Sequence: Synthetic oligonucleotide
cuggaagaaguccucacugu

SEQ ID NO: 2036 - RNA, 20 nt, Artificial Sequence
  Description of Artificial Sequence: Synthetic oligonucleotide
agcuggaagaaguccucacu

SEQ ID NO: 2037 - RNA, 20 nt, Artificial Sequence
  Description of Artificial Sequence: Synthetic oligonucleotide
acugcaacaccaucaggcac

SEQ ID NO: 2038 - RNA, 20 nt, Artificial Sequence
  Description of Artificial Sequence: Synthetic oligonucleotide
gacugcaacaccaucaggca

SEQ ID NO: 2039 - RNA, 20 nt, Artificial Sequence
  Description of Artificial Sequence: Synthetic oligonucleotide
agacugcaacaccaucaggc

SEQ ID NO: 2040 - RNA, 20 nt, Artificial Sequence
  Description of Artificial Sequence: Synthetic oligonucleotide
cagacugcaacaccaucagg

SEQ ID NO: 2041 - RNA, 20 nt, Artificial Sequence
  Description of Artificial Sequence: Synthetic oligonucleotide
ccagacugcaacaccaucag

SEQ ID NO: 2042 - RNA, 20 nt, Artificial Sequence
  Description of Artificial Sequence: Synthetic oligonucleotide
gaccagacugcaacaccauc

SEQ ID NO: 2043 - RNA, 20 nt, Artificial Sequence
  Description of Artificial Sequence: Synthetic oligonucleotide
cucugaccagacugcaacac

SEQ ID NO: 2044 - RNA, 20 nt, Artificial Sequence
  Description of Artificial Sequence: Synthetic oligonucleotide
agcucugaccagacugcaac

SEQ ID NO: 2045 - RNA, 20 nt, Artificial Sequence
  Description of Artificial Sequence: Synthetic oligonucleotide
ccagcucugaccagacugca

SEQ ID NO: 2046 - RNA, 20 nt, Artificial Sequence
  Description of Artificial Sequence: Synthetic oligonucleotide
uguagggcuccagcucugac

SEQ ID NO: 2047 - RNA, 20 nt, Artificial Sequence
  Description of Artificial Sequence: Synthetic oligonucleotide
cuuguagggcuccagcucug

SEQ ID NO: 2048 - RNA, 20 nt, Artificial Sequence
  Description of Artificial Sequence: Synthetic oligonucleotide
ccuuguagggcuccagcucu

SEQ ID NO: 2049 - RNA, 20 nt, Artificial Sequence
  Description of Artificial Sequence: Synthetic oligonucleotide
acaggcauuggaagcagccc

SEQ ID NO: 2050 - RNA, 20 nt, Artificial Sequence
  Description of Artificial Sequence: Synthetic oligonucleotide
gacaggcauuggaagcagcc

SEQ ID NO: 2051 - RNA, 20 nt, Artificial Sequence
  Description of Artificial Sequence: Synthetic oligonucleotide
aaggacaggcauuggaagca

SEQ ID NO: 2052 - RNA, 20 nt, Artificial Sequence
  Description of Artificial Sequence: Synthetic oligonucleotide
aaaggacaggcauuggaagc

SEQ ID NO: 2053 - RNA, 20 nt, Artificial Sequence
  Description of Artificial Sequence: Synthetic oligonucleotide
uaaaggacaggcauuggaag

SEQ ID NO: 2054 - RNA, 20 nt, Artificial Sequence
  Description of Artificial Sequence: Synthetic oligonucleotide
cuaaaggacaggcauuggaa

SEQ ID NO: 2055 - RNA, 20 nt, Artificial Sequence
  Description of Artificial Sequence: Synthetic oligonucleotide
gcucuaaaggacaggcauug

SEQ ID NO: 2056 - RNA, 20 nt, Artificial Sequence
  Description of Artificial Sequence: Synthetic oligonucleotide
agcucuaaaggacaggcauu

SEQ ID NO: 2057 - RNA, 20 nt, Artificial Sequence
  Description of Artificial Sequence: Synthetic oligonucleotide
aagcucuaaaggacaggcau

SEQ ID NO: 2058 - RNA, 20 nt, Artificial Sequence
  Description of Artificial Sequence: Synthetic oligonucleotide
aaagcucuaaaggacaggca

SEQ ID NO: 2059 - RNA, 20 nt, Artificial Sequence
  Description of Artificial Sequence: Synthetic oligonucleotide
gaaagcucuaaaggacaggc

SEQ ID NO: 2060 - RNA, 20 nt, Artificial Sequence
  Description of Artificial Sequence: Synthetic oligonucleotide
cgggaaagcucuaaaggaca

SEQ ID NO: 2061 - RNA, 20 nt, Artificial Sequence
  Description of Artificial Sequence: Synthetic oligonucleotide
ccgggaaagcucuaaaggac

SEQ ID NO: 2062 - RNA, 20 nt, Artificial Sequence
  Description of Artificial Sequence: Synthetic oligonucleotide
aggguuaagcuagagaggaa

SEQ ID NO: 2063 - RNA, 20 nt, Artificial Sequence
  Description of Artificial Sequence: Synthetic oligonucleotide
ucaggguuaagcuagagagg

SEQ ID NO: 2064 - RNA, 20 nt, Artificial Sequence
  Description of Artificial Sequence: Synthetic oligonucleotide
gaucaggguuaagcuagaga

SEQ ID NO: 2065 - RNA, 20 nt, Artificial Sequence
  Description of Artificial Sequence: Synthetic oligonucleotide
ggaucaggguuaagcuagag

SEQ ID NO: 2066 - RNA, 20 nt, Artificial Sequence
  Description of Artificial Sequence: Synthetic oligonucleotide
aggaucaggguuaagcuaga

SEQ ID NO: 2067 - RNA, 20 nt, Artificial Sequence
  Description of Artificial Sequence: Synthetic oligonucleotide
cccaggaucaggguuaagcu

SEQ ID NO: 2068 - RNA, 20 nt, Artificial Sequence
  Description of Artificial Sequence: Synthetic oligonucleotide
caacuccuccugcaccuggu

SEQ ID NO: 2069 - RNA, 20 nt, Artificial Sequence
  Description of Artificial Sequence: Synthetic oligonucleotide
acaacuccuccugcaccugg

SEQ ID NO: 2070 - RNA, 20 nt, Artificial Sequence
  Description of Artificial Sequence: Synthetic oligonucleotide
gacaauuccacaacuccucc

SEQ ID NO: 2071 - RNA, 20 nt, Artificial Sequence
  Description of Artificial Sequence: Synthetic oligonucleotide
ugacaauuccacaacuccuc

SEQ ID NO: 2072 - RNA, 20 nt, Artificial Sequence
  Description of Artificial Sequence: Synthetic oligonucleotide
uugacaauuccacaacuccu

SEQ ID NO: 2073 - RNA, 20 nt, Artificial Sequence
  Description of Artificial Sequence: Synthetic oligonucleotide
cuugacaauuccacaacucc

SEQ ID NO: 2074 - RNA, 20 nt, Artificial Sequence
  Description of Artificial Sequence: Synthetic oligonucleotide
uccuugacaauuccacaacu

SEQ ID NO: 2075 - RNA, 20 nt, Artificial Sequence
  Description of Artificial Sequence: Synthetic oligonucleotide
auccuugacaauuccacaac

SEQ ID NO: 2076 - RNA, 20 nt, Artificial Sequence
  Description of Artificial Sequence: Synthetic oligonucleotide
cauccuugacaauuccacaa

SEQ ID NO: 2077 - RNA, 20 nt, Artificial Sequence
  Description of Artificial Sequence: Synthetic oligonucleotide
acauccuugacaauuccaca

SEQ ID NO: 2078 - RNA, 20 nt, Artificial Sequence
  Description of Artificial Sequence: Synthetic oligonucleotide
gacauccuugacaauuccac

SEQ ID NO: 2079 - RNA, 20 nt, Artificial Sequence
  Description of Artificial Sequence: Synthetic oligonucleotide
ugacauccuugacaauucca

SEQ ID NO: 2080 - RNA, 20 nt, Artificial Sequence
  Description of Artificial Sequence: Synthetic oligonucleotide
ugugugacauccuugacaau

SEQ ID NO: 2081 - RNA, 20 nt, Artificial Sequence
  Description of Artificial Sequence: Synthetic oligonucleotide
acugugugacauccuugaca

SEQ ID NO: 2082 - RNA, 20 nt, Artificial Sequence
  Description of Artificial Sequence: Synthetic oligonucleotide
acuuucuguccacuguguga

SEQ ID NO: 2083 - RNA, 20 nt, Artificial Sequence
  Description of Artificial Sequence: Synthetic oligonucleotide
ccucgcuuggacuuucuguc

SEQ ID NO: 2084 - RNA, 20 nt, Artificial Sequence
  Description of Artificial Sequence: Synthetic oligonucleotide
cccucgcuuggacuuucugu

SEQ ID NO: 2085 - RNA, 20 nt, Artificial Sequence
  Description of Artificial Sequence: Synthetic oligonucleotide
ucccucgcuuggacuuucug

SEQ ID NO: 2086 - RNA, 20 nt, Artificial Sequence
  Description of Artificial Sequence: Synthetic oligonucleotide
cucccucgcuuggacuuucu

SEQ ID NO: 2087 - RNA, 20 nt, Artificial Sequence
  Description of Artificial Sequence: Synthetic oligonucleotide
ccucccucgcuuggacuuuc

SEQ ID NO: 2088 - RNA, 20 nt, Artificial Sequence
  Description of Artificial Sequence: Synthetic oligonucleotide
cccucccucgcuuggacuuu

SEQ ID NO: 2089 - RNA, 20 nt, Artificial Sequence
  Description of Artificial Sequence: Synthetic oligonucleotide
uccaucagcacugggucaga

SEQ ID NO: 2090 - RNA, 20 nt, Artificial Sequence
  Description of Artificial Sequence: Synthetic oligonucleotide
accacuaaucuccaucagca

SEQ ID NO: 2091 - RNA, 20 nt, Artificial Sequence
  Description of Artificial Sequence: Synthetic oligonucleotide
caccacuaaucuccaucagc

SEQ ID NO: 2092 - RNA, 20 nt, Artificial Sequence
  Description of Artificial Sequence: Synthetic oligonucleotide
ccaccacuaaucuccaucag

SEQ ID NO: 2093 - RNA, 20 nt, Artificial Sequence
  Description of Artificial Sequence: Synthetic oligonucleotide
cccaccacuaaucuccauca

SEQ ID NO: 2094 - RNA, 20 nt, Artificial Sequence
  Description of Artificial Sequence: Synthetic oligonucleotide
accagacacccaccacuaau

SEQ ID NO: 2095 - RNA, 20 nt, Artificial Sequence
  Description of Artificial Sequence: Synthetic oligonucleotide
uaccagacacccaccacuaa

SEQ ID NO: 2096 - RNA, 20 nt, Artificial Sequence
  Description of Artificial Sequence: Synthetic oligonucleotide
cucauaccagacacccacca

SEQ ID NO: 2097 - RNA, 20 nt, Artificial Sequence
  Description of Artificial Sequence: Synthetic oligonucleotide
ccucauaccagacacccacc

SEQ ID NO: 2098 - RNA, 20 nt, Artificial Sequence
  Description of Artificial Sequence: Synthetic oligonucleotide
uccucauaccagacacccac

SEQ ID NO: 2099 - RNA, 20 nt, Artificial Sequence
  Description of Artificial Sequence: Synthetic oligonucleotide
auccucauaccagacaccca

SEQ ID NO: 2100 - RNA, 20 nt, Artificial Sequence
  Description of Artificial Sequence: Synthetic oligonucleotide
gauccucauaccagacaccc

SEQ ID NO: 2101 - RNA, 20 nt, Artificial Sequence
  Description of Artificial Sequence: Synthetic oligonucleotide
agauccucauaccagacacc

SEQ ID NO: 2102 - RNA, 20 nt, Artificial Sequence
  Description of Artificial Sequence: Synthetic oligonucleotide
uagauccucauaccagacac

SEQ ID NO: 2103 - RNA, 20 nt, Artificial Sequence
  Description of Artificial Sequence: Synthetic oligonucleotide
guagauccucauaccagaca

SEQ ID NO: 2104 - RNA, 20 nt, Artificial Sequence
  Description of Artificial Sequence: Synthetic oligonucleotide
aguagauccucauaccagac

SEQ ID NO: 2105 - RNA, 20 nt, Artificial Sequence
  Description of Artificial Sequence: Synthetic oligonucleotide
caguagauccucauaccaga

SEQ ID NO: 2106 - RNA, 20 nt, Artificial Sequence
  Description of Artificial Sequence: Synthetic oligonucleotide
ugcaguagauccucauacca

SEQ ID NO: 2107 - RNA, 20 nt, Artificial Sequence
  Description of Artificial Sequence: Synthetic oligonucleotide
gugcaguagauccucauacc

SEQ ID NO: 2108 - RNA, 20 nt, Artificial Sequence
  Description of Artificial Sequence: Synthetic oligonucleotide
agugcaguagauccucauac

SEQ ID NO: 2109 - RNA, 20 nt, Artificial Sequence
  Description of Artificial Sequence: Synthetic oligonucleotide
acucuguaggacacccuugu

SEQ ID NO: 2110 - RNA, 20 nt, Artificial Sequence
  Description of Artificial Sequence: Synthetic oligonucleotide
cacucuguaggacacccuug

SEQ ID NO: 2111 - RNA, 20 nt, Artificial Sequence
  Description of Artificial Sequence: Synthetic oligonucleotide
ccacucuguaggacacccuu

SEQ ID NO: 2112 - RNA, 20 nt, Artificial Sequence
  Description of Artificial Sequence: Synthetic oligonucleotide
uccacucuguaggacacccu

SEQ ID NO: 2113 - RNA, 20 nt, Artificial Sequence
  Description of Artificial Sequence: Synthetic oligonucleotide
cuccacucuguaggacaccc

SEQ ID NO: 2114 - RNA, 20 nt, Artificial Sequence
  Description of Artificial Sequence: Synthetic oligonucleotide
acuccacucuguaggacacc

SEQ ID NO: 2115 - RNA, 20 nt, Artificial Sequence
  Description of Artificial Sequence: Synthetic oligonucleotide
cacuccacucuguaggacac

SEQ ID NO: 2116 - RNA, 20 nt, Artificial Sequence
  Description of Artificial Sequence: Synthetic oligonucleotide
agcacuccacucuguaggac

SEQ ID NO: 2117 - RNA, 20 nt, Artificial Sequence
  Description of Artificial Sequence: Synthetic oligonucleotide
uaugacagcacuccacucug

SEQ ID NO: 2118 - RNA, 20 nt, Artificial Sequence
  Description of Artificial Sequence: Synthetic oligonucleotide
auaugacagcacuccacucu

SEQ ID NO: 2119 - RNA, 20 nt, Artificial Sequence
  Description of Artificial Sequence: Synthetic oligonucleotide
uugcugugcuugggccucuc

SEQ ID NO: 2120 - RNA, 20 nt, Artificial Sequence
  Description of Artificial Sequence: Synthetic oligonucleotide
acgucaaaggugaaucgggc

SEQ ID NO: 2121 - RNA, 20 nt, Artificial Sequence
  Description of Artificial Sequence: Synthetic oligonucleotide
cacgucaaaggugaaucggg

SEQ ID NO: 2122 - RNA, 20 nt, Artificial Sequence
  Description of Artificial Sequence: Synthetic oligonucleotide
acacgucaaaggugaaucgg

SEQ ID NO: 2123 - RNA, 20 nt, Artificial Sequence
  Description of Artificial Sequence: Synthetic oligonucleotide
uacacgucaaaggugaaucg

SEQ ID NO: 2124 - RNA, 20 nt, Artificial Sequence
  Description of Artificial Sequence: Synthetic oligonucleotide
guacacgucaaaggugaauc

SEQ ID NO: 2125 - RNA, 20 nt, Artificial Sequence
  Description of Artificial Sequence: Synthetic oligonucleotide
ggcugccaaagaggucucga

SEQ ID NO: 2126 - RNA, 20 nt, Artificial Sequence
  Description of Artificial Sequence: Synthetic oligonucleotide
ucaggcugccaaagaggucu

SEQ ID NO: 2127 - RNA, 20 nt, Artificial Sequence
  Description of Artificial Sequence: Synthetic oligonucleotide
cauucaggcugccaaagagg

SEQ ID NO: 2128 - RNA, 20 nt, Artificial Sequence
  Description of Artificial Sequence: Synthetic oligonucleotide
gacauucaggcugccaaaga

SEQ ID NO: 2129 - RNA, 20 nt, Artificial Sequence
  Description of Artificial Sequence: Synthetic oligonucleotide
ugacauucaggcugccaaag

SEQ ID NO: 2130 - RNA, 20 nt, Artificial Sequence
  Description of Artificial Sequence: Synthetic oligonucleotide
cuuugacauucaggcugcca

SEQ ID NO: 2131 - RNA, 20 nt, Artificial Sequence
  Description of Artificial Sequence: Synthetic oligonucleotide
gcuuugacauucaggcugcc

SEQ ID NO: 2132 - RNA, 20 nt, Artificial Sequence
  Description of Artificial Sequence: Synthetic oligonucleotide
ccguagaauguggcuuugac

SEQ ID NO: 2133 - RNA, 20 nt, Artificial Sequence
  Description of Artificial Sequence: Synthetic oligonucleotide
gcccguagaauguggcuuug

SEQ ID NO: 2134 - RNA, 20 nt, Artificial Sequence
  Description of Artificial Sequence: Synthetic oligonucleotide
uagagcccguagaauguggc

SEQ ID NO: 2135 - RNA, 20 nt, Artificial Sequence
  Description of Artificial Sequence: Synthetic oligonucleotide
guagagcccguagaaugugg

SEQ ID NO: 2136 - RNA, 20 nt, Artificial Sequence
  Description of Artificial Sequence: Synthetic oligonucleotide
aguagagcccguagaaugug

SEQ ID NO: 2137 - RNA, 20 nt, Artificial Sequence
  Description of Artificial Sequence: Synthetic oligonucleotide
agaguagagcccguagaaug

SEQ ID NO: 2138 - RNA, 20 nt, Artificial Sequence
  Description of Artificial Sequence: Synthetic oligonucleotide
uagaguagagcccguagaau

SEQ ID NO: 2139 - RNA, 20 nt, Artificial Sequence
  Description of Artificial Sequence: Synthetic oligonucleotide
auagaguagagcccguagaa

SEQ ID NO: 2140 - RNA, 20 nt, Artificial Sequence
  Description of Artificial Sequence: Synthetic oligonucleotide
cauagaguagagcccguaga

SEQ ID NO: 2141 - RNA, 20 nt, Artificial Sequence
  Description of Artificial Sequence: Synthetic oligonucleotide
ucauagaguagagcccguag

SEQ ID NO: 2142 - RNA, 20 nt, Artificial Sequence
  Description of Artificial Sequence: Synthetic oligonucleotide
cucauagaguagagcccgua

SEQ ID NO: 2143 - RNA, 20 nt, Artificial Sequence
  Description of Artificial Sequence: Synthetic oligonucleotide
gaaagucacaacucauagag

SEQ ID NO: 2144 - RNA, 20 nt, Artificial Sequence
  Description of Artificial Sequence: Synthetic oligonucleotide
ccuugaaagucacaacucau

SEQ ID NO: 2145 - RNA, 20 nt, Artificial Sequence
  Description of Artificial Sequence: Synthetic oligonucleotide
aaguccuugaaagucacaac

SEQ ID NO: 2146 - RNA, 20 nt, Artificial Sequence
  Description of Artificial Sequence: Synthetic oligonucleotide
ccaaguccuugaaagucaca

SEQ ID NO: 2147 - RNA, 20 nt, Artificial Sequence
  Description of Artificial Sequence: Synthetic oligonucleotide
uucuuugggccaaguccuug

SEQ ID NO: 2148 - RNA, 20 nt, Artificial Sequence
  Description of Artificial Sequence: Synthetic oligonucleotide
uuucuuugggccaaguccuu

SEQ ID NO: 2149 - RNA, 20 nt, Artificial Sequence
  Description of Artificial Sequence: Synthetic oligonucleotide
uugauuucugaccugaguac

SEQ ID NO: 2150 - RNA, 20 nt, Artificial Sequence
  Description of Artificial Sequence: Synthetic oligonucleotide
guugauuucugaccugagua

SEQ ID NO: 2151 - RNA, 20 nt, Artificial Sequence
  Description of Artificial Sequence: Synthetic oligonucleotide
gggacuauccaacuguaggg

SEQ ID NO: 2152 - RNA, 20 nt, Artificial Sequence
  Description of Artificial Sequence: Synthetic oligonucleotide
gcaagaggacgaauuauggg

SEQ ID NO: 2153 - RNA, 20 nt, Artificial Sequence
  Description of Artificial Sequence: Synthetic oligonucleotide
ugcaagaggacgaauuaugg

SEQ ID NO: 2154 - RNA, 20 nt, Artificial Sequence
  Description of Artificial Sequence: Synthetic oligonucleotide
gugcaagaggacgaauuaug

SEQ ID NO: 2155 - RNA, 20 nt, Artificial Sequence
  Description of Artificial Sequence: Synthetic oligonucleotide
ggugcaagaggacgaauuau

SEQ ID NO: 2156 - RNA, 20 nt, Artificial Sequence
  Description of Artificial Sequence: Synthetic oligonucleotide
gggugcaagaggacgaauua

SEQ ID NO: 2157 - RNA, 20 nt, Artificial Sequence
  Description of Artificial Sequence: Synthetic oligonucleotide
ugggugcaagaggacgaauu

SEQ ID NO: 2158 - RNA, 20 nt, Artificial Sequence
  Description of Artificial Sequence: Synthetic oligonucleotide
gugggugcaagaggacgaau

SEQ ID NO: 2159 - RNA, 20 nt, Artificial Sequence
  Description of Artificial Sequence: Synthetic oligonucleotide
ggugggugcaagaggacgaa

SEQ ID NO: 2160 - RNA, 20 nt, Artificial Sequence
  Description of Artificial Sequence: Synthetic oligonucleotide
uaggugggugcaagaggacg

SEQ ID NO: 2161 - RNA, 20 nt, Artificial Sequence
  Description of Artificial Sequence: Synthetic oligonucleotide
guaggugggugcaagaggac

SEQ ID NO: 2162 - RNA, 20 nt, Artificial Sequence
  Description of Artificial Sequence: Synthetic oligonucleotide
gguaggugggugcaagagga

SEQ ID NO: 2163 - RNA, 20 nt, Artificial Sequence
  Description of Artificial Sequence: Synthetic oligonucleotide
ccacaagcaagagcuaacua

SEQ ID NO: 2164 - RNA, 20 nt, Artificial Sequence
  Description of Artificial Sequence: Synthetic oligonucleotide
acuuuccacaagcaagagcu

SEQ ID NO: 2165 - RNA, 20 nt, Artificial Sequence
  Description of Artificial Sequence: Synthetic oligonucleotide
gacuuuccacaagcaagagc

SEQ ID NO: 2166 - RNA, 20 nt, Artificial Sequence
  Description of Artificial Sequence: Synthetic oligonucleotide
ggacuuuccacaagcaagag

SEQ ID NO: 2167 - RNA, 20 nt, Artificial Sequence
  Description of Artificial Sequence: Synthetic oligonucleotide
aggacuuuccacaagcaaga

SEQ ID NO: 2168 - RNA, 20 nt, Artificial Sequence
  Description of Artificial Sequence: Synthetic oligonucleotide
gaggacuuuccacaagcaag

SEQ ID NO: 2169 - RNA, 20 nt, Artificial Sequence
  Description of Artificial Sequence: Synthetic oligonucleotide
ugaggacuuuccacaagcaa

SEQ ID NO: 2170 - RNA, 20 nt, Artificial Sequence
  Description of Artificial Sequence: Synthetic oligonucleotide
augaggacuuuccacaagca

SEQ ID NO: 2171 - RNA, 20 nt, Artificial Sequence
  Description of Artificial Sequence: Synthetic oligonucleotide
gaugaggacuuuccacaagc

SEQ ID NO: 2172 - RNA, 20 nt, Artificial Sequence
  Description of Artificial Sequence: Synthetic oligonucleotide
agaugaggacuuuccacaag

SEQ ID NO: 2173 - RNA, 20 nt, Artificial Sequence
  Description of Artificial Sequence: Synthetic oligonucleotide
gagaugaggacuuuccacaa

SEQ ID NO: 2174 - RNA, 20 nt, Artificial Sequence
  Description of Artificial Sequence: Synthetic oligonucleotide
ggagaugaggacuuuccaca

SEQ ID NO: 2175 - RNA, 20 nt, Artificial Sequence
  Description of Artificial Sequence: Synthetic oligonucleotide
ugggagaugaggacuuucca

SEQ ID NO: 2176 - RNA, 20 nt, Artificial Sequence
  Description of Artificial Sequence: Synthetic oligonucleotide
gcugggagaugaggacuuuc

SEQ ID NO: 2177 - RNA, 20 nt, Artificial Sequence
  Description of Artificial Sequence: Synthetic oligonucleotide
ucaagcugggagaugaggac

SEQ ID NO: 2178 - RNA, 20 nt, Artificial Sequence
  Description of Artificial Sequence: Synthetic oligonucleotide
aagccaucaagcugggagau

SEQ ID NO: 2179 - RNA, 20 nt, Artificial Sequence
  Description of Artificial Sequence: Synthetic oligonucleotide
gaagccaucaagcugggaga

SEQ ID NO: 2180 - RNA, 20 nt, Artificial Sequence
  Description of Artificial Sequence: Synthetic oligonucleotide
ggaggaagccaucaagcugg

SEQ ID NO: 2181 - RNA, 20 nt, Artificial Sequence
  Description of Artificial Sequence: Synthetic oligonucleotide
gggaggaagccaucaagcug

SEQ ID NO: 2182 - RNA, 20 nt, Artificial Sequence
  Description of Artificial Sequence: Synthetic oligonucleotide
aacuugggaggaagccauca

SEQ ID NO: 2183 - RNA, 20 nt, Artificial Sequence
  Description of Artificial Sequence: Synthetic oligonucleotide
aaacuugggaggaagccauc

SEQ ID NO: 2184 - RNA, 20 nt, Artificial Sequence
  Description of Artificial Sequence: Synthetic oligonucleotide
cagcaguguggagguccaac

SEQ ID NO: 2185 - RNA, 20 nt, Artificial Sequence
  Description of Artificial Sequence: Synthetic oligonucleotide
gcagcaguguggagguccaa

SEQ ID NO: 2186 - RNA, 20 nt, Artificial Sequence
  Description of Artificial Sequence: Synthetic oligonucleotide
ugcagcaguguggaggucca

SEQ ID NO: 2187 - RNA, 20 nt, Artificial Sequence
  Description of Artificial Sequence: Synthetic oligonucleotide
uugcagcaguguggaggucc

SEQ ID NO: 2188 - RNA, 20 nt, Artificial Sequence
  Description of Artificial Sequence: Synthetic oligonucleotide
gguggaggaaauucccagca

SEQ ID NO: 2189 - RNA, 20 nt, Artificial Sequence
  Description of Artificial Sequence: Synthetic oligonucleotide
acgaaggguggaggaaauuc

SEQ ID NO: 2190 - RNA, 20 nt, Artificial Sequence
  Description of Artificial Sequence: Synthetic oligonucleotide
gacgaaggguggaggaaauu

SEQ ID NO: 2191 - RNA, 20 nt, Artificial Sequence
  Description of Artificial Sequence: Synthetic oligonucleotide
augacgaaggguggaggaaa

SEQ ID NO: 2192 - RNA, 20 nt, Artificial Sequence
  Description of Artificial Sequence: Synthetic oligonucleotide
caugacgaaggguggaggaa

SEQ ID NO: 2193 - RNA, 20 nt, Artificial Sequence
  Description of Artificial Sequence: Synthetic oligonucleotide
gcaugacgaaggguggagga

SEQ ID NO: 2194 - RNA, 20 nt, Artificial Sequence
  Description of Artificial Sequence: Synthetic oligonucleotide
ugcaugacgaaggguggagg

SEQ ID NO: 2195 - RNA, 20 nt, Artificial Sequence
  Description of Artificial Sequence: Synthetic oligonucleotide
cugcaugacgaaggguggag

SEQ ID NO: 2196 - RNA, 20 nt, Artificial Sequence
  Description of Artificial Sequence: Synthetic oligonucleotide
acugcaugacgaagggugga

SEQ ID NO: 2197 - RNA, 20 nt, Artificial Sequence
  Description of Artificial Sequence: Synthetic oligonucleotide
cacugcaugacgaagggugg

SEQ ID NO: 2198 - RNA, 20 nt, Artificial Sequence
  Description of Artificial Sequence: Synthetic oligonucleotide
ccacugcaugacgaagggug

SEQ ID NO: 2199 - RNA, 20 nt, Artificial Sequence
  Description of Artificial Sequence: Synthetic oligonucleotide
uccacugcaugacgaagggu

SEQ ID NO: 2200 - RNA, 20 nt, Artificial Sequence
  Description of Artificial Sequence: Synthetic oligonucleotide
cuccacugcaugacgaaggg

SEQ ID NO: 2201 - RNA, 20 nt, Artificial Sequence
  Description of Artificial Sequence: Synthetic oligonucleotide
ccuccacugcaugacgaagg

SEQ ID NO: 2202 - RNA, 20 nt, Artificial Sequence
  Description of Artificial Sequence: Synthetic oligonucleotide
cccuccacugcaugacgaag

SEQ ID NO: 2203 - RNA, 20 nt, Artificial Sequence
  Description of Artificial Sequence: Synthetic oligonucleotide
cuuaguaggaauggaggcgg

SEQ ID NO: 2204 - RNA, 20 nt, Artificial Sequence
  Description of Artificial Sequence: Synthetic oligonucleotide
ccuuaguaggaauggaggcg

SEQ ID NO: 2205 - RNA, 20 nt, Artificial Sequence
  Description of Artificial Sequence: Synthetic oligonucleotide
cccuuaguaggaauggaggc

SEQ ID NO: 2206 - RNA, 20 nt, Artificial Sequence
  Description of Artificial Sequence: Synthetic oligonucleotide
ucgguuggaaugauucuggg

SEQ ID NO: 2207 - RNA, 20 nt, Artificial Sequence
  Description of Artificial Sequence: Synthetic oligonucleotide
gucgguuggaaugauucugg

SEQ ID NO: 2208 - RNA, 20 nt, Artificial Sequence
  Description of Artificial Sequence: Synthetic oligonucleotide
ggucgguuggaaugauucug

SEQ ID NO: 2209 - RNA, 20 nt, Artificial Sequence
  Description of Artificial Sequence: Synthetic oligonucleotide
gggucgguuggaaugauucu

SEQ ID NO: 2210 - RNA, 20 nt, Artificial Sequence
  Description of Artificial Sequence: Synthetic oligonucleotide
ugggucgguuggaaugauuc

SEQ ID NO: 2211 - RNA, 20 nt, Artificial Sequence
  Description of Artificial Sequence: Synthetic oligonucleotide
gugggucgguuggaaugauu

SEQ ID NO: 2212 - RNA, 20 nt, Artificial Sequence
  Description of Artificial Sequence: Synthetic oligonucleotide
agugggucgguuggaaugau

SEQ ID NO: 2213 - RNA, 20 nt, Artificial Sequence
  Description of Artificial Sequence: Synthetic oligonucleotide
cagugggucgguuggaauga

SEQ ID NO: 2214 - RNA, 20 nt, Artificial Sequence
  Description of Artificial Sequence: Synthetic oligonucleotide
gcagugggucgguuggaaug

SEQ ID NO: 2215 - RNA, 20 nt, Artificial Sequence
  Description of Artificial Sequence: Synthetic oligonucleotide
ugcagugggucgguuggaau

SEQ ID NO: 2216 - RNA, 20 nt, Artificial Sequence
  Description of Artificial Sequence: Synthetic oligonucleotide
uugcagugggucgguuggaa

SEQ ID NO: 2217 - RNA, 20 nt, Artificial Sequence
  Description of Artificial Sequence: Synthetic oligonucleotide
uuugcagugggucgguugga

SEQ ID NO: 2218 - RNA, 20 nt, Artificial Sequence
  Description of Artificial Sequence: Synthetic oligonucleotide
cuuugcagugggucgguugg

SEQ ID NO: 2219 - RNA, 20 nt, Artificial Sequence
  Description of Artificial Sequence: Synthetic oligonucleotide
ucuuugcagugggucgguug

SEQ ID NO: 2220 - RNA, 20 nt, Artificial Sequence
  Description of Artificial Sequence: Synthetic oligonucleotide
uagucuuugcagugggucgg

SEQ ID NO: 2221 - RNA, 20 nt, Artificial Sequence
  Description of Artificial Sequence: Synthetic oligonucleotide
auagucuuugcagugggucg

SEQ ID NO: 2222 - RNA, 20 nt, Artificial Sequence
  Description of Artificial Sequence: Synthetic oligonucleotide
cugucauagucuuugcagug

SEQ ID NO: 2223 - RNA, 20 nt, Artificial Sequence
  Description of Artificial Sequence: Synthetic oligonucleotide
ugcugucauagucuuugcag

SEQ ID NO: 2224 - RNA, 20 nt, Artificial Sequence
  Description of Artificial Sequence: Synthetic oligonucleotide
ucuagccuguacugucugca

SEQ ID NO: 2225 - RNA, 20 nt, Artificial Sequence
  Description of Artificial Sequence: Synthetic oligonucleotide
aucuagccuguacugucugc

SEQ ID NO: 2226 - RNA, 20 nt, Artificial Sequence
  Description of Artificial Sequence: Synthetic oligonucleotide
uaucuagccuguacugucug

SEQ ID NO: 2227 - RNA, 20 nt, Artificial Sequence
  Description of Artificial Sequence: Synthetic oligonucleotide
uuaucuagccuguacugucu

SEQ ID NO: 2228 - RNA, 20 nt, Artificial Sequence
  Description of Artificial Sequence: Synthetic oligonucleotide
guuaucuagccuguacuguc

SEQ ID NO: 2229 - RNA, 20 nt, Artificial Sequence
  Description of Artificial Sequence: Synthetic oligonucleotide
gguuaucuagccuguacugu

SEQ ID NO: 2230 - RNA, 20 nt, Artificial Sequence
  Description of Artificial Sequence: Synthetic oligonucleotide
ggguuaucuagccuguacug

SEQ ID NO: 2231 - RNA, 20 nt, Artificial Sequence
  Description of Artificial Sequence: Synthetic oligonucleotide
uggguuaucuagccuguacu

SEQ ID NO: 2232 - RNA, 20 nt, Artificial Sequence
  Description of Artificial Sequence: Synthetic oligonucleotide
guggguuaucuagccuguac

SEQ ID NO: 2233 - RNA, 20 nt, Artificial Sequence
  Description of Artificial Sequence: Synthetic oligonucleotide
gguggguuaucuagccugua

SEQ ID NO: 2234 - RNA, 20 nt, Artificial Sequence
  Description of Artificial Sequence: Synthetic oligonucleotide
ggguggguuaucuagccugu

SEQ ID NO: 2235 - RNA, 20 nt, Artificial Sequence
  Description of Artificial Sequence: Synthetic oligonucleotide
uggguggguuaucuagccug

SEQ ID NO: 2236 - RNA, 20 nt, Artificial Sequence
  Description of Artificial Sequence: Synthetic oligonucleotide
uuggguggguuaucuagccu

SEQ ID NO: 2237 - RNA, 20 nt, Artificial Sequence
  Description of Artificial Sequence: Synthetic oligonucleotide
auuggguggguuaucuagcc

SEQ ID NO: 2238 - RNA, 20 nt, Artificial Sequence
  Description of Artificial Sequence: Synthetic oligonucleotide
aauuggguggguuaucuagc

SEQ ID NO: 2239 - RNA, 20 nt, Artificial Sequence
  Description of Artificial Sequence: Synthetic oligonucleotide
aaauuggguggguuaucuag

SEQ ID NO: 2240 - RNA, 20 nt, Artificial Sequence
  Description of Artificial Sequence: Synthetic oligonucleotide
ggaaauuggguggguuaucu

SEQ ID NO: 2241 - RNA, 20 nt, Artificial Sequence
  Description of Artificial Sequence: Synthetic oligonucleotide
gggaaauuggguggguuauc

SEQ ID NO: 2242 - RNA, 20 nt, Artificial Sequence
  Description of Artificial Sequence: Synthetic oligonucleotide
gaaagguucugucacgaggg

SEQ ID NO: 2243 - RNA, 20 nt, Artificial Sequence
  Description of Artificial Sequence: Synthetic oligonucleotide
gcugaaagguucugucacga

SEQ ID NO: 2244 - RNA, 20 nt, Artificial Sequence
  Description of Artificial Sequence: Synthetic oligonucleotide
ugcugaaagguucugucacg

SEQ ID NO: 2245 - RNA, 20 nt, Artificial Sequence
  Description of Artificial Sequence: Synthetic oligonucleotide
ggcguuaugcugaaagguuc

SEQ ID NO: 2246 - RNA, 20 nt, Artificial Sequence
  Description of Artificial Sequence: Synthetic oligonucleotide
aggcguuaugcugaaagguu

SEQ ID NO: 2247 - RNA, 20 nt, Artificial Sequence
  Description of Artificial Sequence: Synthetic oligonucleotide
gaggcguuaugcugaaaggu

SEQ ID NO: 2248 - RNA, 20 nt, Artificial Sequence
  Description of Artificial Sequence: Synthetic oligonucleotide
ugaggcguuaugcugaaagg

SEQ ID NO: 2249 - RNA, 20 nt, Artificial Sequence
  Description of Artificial Sequence: Synthetic oligonucleotide
gugaggcguuaugcugaaag

SEQ ID NO: 2250 - RNA, 20 nt, Artificial Sequence
  Description of Artificial Sequence: Synthetic oligonucleotide
augugaggcguuaugcugaa

SEQ ID NO: 2251 - RNA, 20 nt, Artificial Sequence
  Description of Artificial Sequence: Synthetic oligonucleotide
gaugugaggcguuaugcuga

SEQ ID NO: 2252 - RNA, 20 nt, Artificial Sequence
  Description of Artificial Sequence: Synthetic oligonucleotide
ggaugugaggcguuaugcug

SEQ ID NO: 2253 - RNA, 20 nt, Artificial Sequence
  Description of Artificial Sequence: Synthetic oligonucleotide
gggaugugaggcguuaugcu

SEQ ID NO: 2254 - RNA, 20 nt, Artificial Sequence
  Description of Artificial Sequence: Synthetic oligonucleotide
cuugggaugugaggcguuau

SEQ ID NO: 2255 - RNA, 20 nt, Artificial Sequence
  Description of Artificial Sequence: Synthetic oligonucleotide
agacuugggaugugaggcgu

SEQ ID NO: 2256 - RNA, 20 nt, Artificial Sequence
  Description of Artificial Sequence: Synthetic oligonucleotide
uagacuugggaugugaggcg

SEQ ID NO: 2257 - RNA, 20 nt, Artificial Sequence
  Description of Artificial Sequence: Synthetic oligonucleotide
auagacuugggaugugaggc

SEQ ID NO: 2258 - RNA, 20 nt, Artificial Sequence
  Description of Artificial Sequence: Synthetic oligonucleotide
uauagacuugggaugugagg

SEQ ID NO: 2259 - RNA, 20 nt, Artificial Sequence
  Description of Artificial Sequence: Synthetic oligonucleotide
ggguauagacuugggaugug

SEQ ID NO: 2260 - RNA, 20 nt, Artificial Sequence
  Description of Artificial Sequence: Synthetic oligonucleotide
aggguauagacuugggaugu

SEQ ID NO: 2261 - RNA, 20 nt, Artificial Sequence
  Description of Artificial Sequence: Synthetic oligonucleotide
aagguggcuaggaaagaaca

SEQ ID NO: 2262 - RNA, 20 nt, Artificial Sequence
  Description of Artificial Sequence: Synthetic oligonucleotide
aaagguggcuaggaaagaac

SEQ ID NO: 2263 - RNA, 20 nt, Artificial Sequence
  Description of Artificial Sequence: Synthetic oligonucleotide
gaaagguggcuaggaaagaa

SEQ ID NO: 2264 - RNA, 20 nt, Artificial Sequence
  Description of Artificial Sequence: Synthetic oligonucleotide
acaucuugaucuuggccuuu

SEQ ID NO: 2265 - RNA, 20 nt, Artificial Sequence
  Description of Artificial Sequence: Synthetic oligonucleotide
ggcugggaucaagaugccug

SEQ ID NO: 2266 - RNA, 20 nt, Artificial Sequence
  Description of Artificial Sequence: Synthetic oligonucleotide
gucaggcugggaucaagaug

SEQ ID NO: 2267 - RNA, 20 nt, Artificial Sequence
  Description of Artificial Sequence: Synthetic oligonucleotide
agucaggcugggaucaagau

SEQ ID NO: 2268 - RNA, 20 nt, Artificial Sequence
  Description of Artificial Sequence: Synthetic oligonucleotide
cagucaggcugggaucaaga

SEQ ID NO: 2269 - RNA, 20 nt, Artificial Sequence
  Description of Artificial Sequence: Synthetic oligonucleotide
agcagucaggcugggaucaa

SEQ ID NO: 2270 - RNA, 20 nt, Artificial Sequence
  Description of Artificial Sequence: Synthetic oligonucleotide
gauguagcagcagucaggcu

SEQ ID NO: 2271 - RNA, 20 nt, Artificial Sequence
  Description of Artificial Sequence: Synthetic oligonucleotide
ggauuagauguagcagcagu

SEQ ID NO: 2272 - RNA, 20 nt, Artificial Sequence
  Description of Artificial Sequence: Synthetic oligonucleotide
gggauuagauguagcagcag

SEQ ID NO: 2273 - RNA, 20 nt, Artificial Sequence
  Description of Artificial Sequence: Synthetic oligonucleotide
gacaggaggcauugguaggg

SEQ ID NO: 2274 - RNA, 20 nt, Artificial Sequence
  Description of Artificial Sequence: Synthetic oligonucleotide
uuagggacaggaggcauugg

SEQ ID NO: 2275 - RNA, 20 nt, Artificial Sequence
  Description of Artificial Sequence: Synthetic oligonucleotide
uuuagggacaggaggcauug

SEQ ID NO: 2276 - RNA, 20 nt, Artificial Sequence
  Description of Artificial Sequence: Synthetic oligonucleotide
gaguuuagggacaggaggca

SEQ ID NO: 2277 - RNA, 20 nt, Artificial Sequence
  Description of Artificial Sequence: Synthetic oligonucleotide
ggaguuuagggacaggaggc

SEQ ID NO: 2278 - RNA, 20 nt, Artificial Sequence
  Description of Artificial Sequence: Synthetic oligonucleotide
gcugucaucaguaugcuggg

SEQ ID NO: 2279 - RNA, 20 nt, Artificial Sequence
  Description of Artificial Sequence: Synthetic oligonucleotide
ggcugucaucaguaugcugg

SEQ ID NO: 2280 - RNA, 20 nt, Artificial Sequence
  Description of Artificial Sequence: Synthetic oligonucleotide
gggcugucaucaguaugcug

SEQ ID NO: 2281 - RNA, 20 nt, Artificial Sequence
  Description of Artificial Sequence: Synthetic oligonucleotide
agggcugucaucaguaugcu

SEQ ID NO: 2282 - RNA, 20 nt, Artificial Sequence
  Description of Artificial Sequence: Synthetic oligonucleotide
agagagggcugucaucagua

SEQ ID NO: 2283 - RNA, 20 nt, Artificial Sequence
  Description of Artificial Sequence: Synthetic oligonucleotide
cagagagggcugucaucagu

SEQ ID NO: 2284 - RNA, 20 nt, Artificial Sequence
  Description of Artificial Sequence: Synthetic oligonucleotide
ucagagagggcugucaucag

SEQ ID NO: 2285 - RNA, 20 nt, Artificial Sequence
  Description of Artificial Sequence: Synthetic oligonucleotide
gucagagagggcugucauca

SEQ ID NO: 2286 - RNA, 20 nt, Artificial Sequence
  Description of Artificial Sequence: Synthetic oligonucleotide
gguaaagucagagagggcug

SEQ ID NO: 2287 - RNA, 20 nt, Artificial Sequence
  Description of Artificial Sequence: Synthetic oligonucleotide
gggaaggguaugaagacaga

SEQ ID NO: 2288 - RNA, 20 nt, Artificial Sequence
  Description of Artificial Sequence: Synthetic oligonucleotide
guuucuggcucucaggcucu

SEQ ID NO: 2289 - RNA, 20 nt, Artificial Sequence
  Description of Artificial Sequence: Synthetic oligonucleotide
gguuucuggcucucaggcuc

SEQ ID NO: 2290 - RNA, 20 nt, Artificial Sequence
  Description of Artificial Sequence: Synthetic oligonucleotide
cgguuucuggcucucaggcu

SEQ ID NO: 2291 - RNA, 20 nt, Artificial Sequence
  Description of Artificial Sequence: Synthetic oligonucleotide
ggacgguuucuggcucucag

SEQ ID NO: 2292 - RNA, 20 nt, Artificial Sequence
  Description of Artificial Sequence: Synthetic oligonucleotide
gggacgguuucuggcucuca

SEQ ID NO: 2293 - RNA, 20 nt, Artificial Sequence
  Description of Artificial Sequence: Synthetic oligonucleotide
ugaaaugugacuucuggugu

SEQ ID NO: 2294 - RNA, 20 nt, Artificial Sequence
  Description of Artificial Sequence: Synthetic oligonucleotide
gggaaccauguaaaaggaug

SEQ ID NO: 2295 - RNA, 20 nt, Artificial Sequence
  Description of Artificial Sequence: Synthetic oligonucleotide
gugaggguagaugggaacca

SEQ ID NO: 2296 - RNA, 20 nt, Artificial Sequence
  Description of Artificial Sequence: Synthetic oligonucleotide
uugugaggguagaugggaac

SEQ ID NO: 2297 - RNA, 20 nt, Artificial Sequence
  Description of Artificial Sequence: Synthetic oligonucleotide
guugugaggguagaugggaa

SEQ ID NO: 2298 - RNA, 20 nt, Artificial Sequence
  Description of Artificial Sequence: Synthetic oligonucleotide
uguugugaggguagauggga

SEQ ID NO: 2299 - RNA, 20 nt, Artificial Sequence
  Description of Artificial Sequence: Synthetic oligonucleotide
augugugucuuuggugauga

SEQ ID NO: 2300 - RNA, 20 nt, Artificial Sequence
  Description of Artificial Sequence: Synthetic oligonucleotide
ggagcuuguaugugugucuu

SEQ ID NO: 2301 - RNA, 20 nt, Artificial Sequence
  Description of Artificial Sequence: Synthetic oligonucleotide
uuggagcuuguauguguguc

SEQ ID NO: 2302 - RNA, 20 nt, Artificial Sequence
  Description of Artificial Sequence: Synthetic oligonucleotide
auuggagcuuguaugugugu

SEQ ID NO: 2303 - RNA, 20 nt, Artificial Sequence
  Description of Artificial Sequence: Synthetic oligonucleotide
cauuggagcuuguaugugug

SEQ ID NO: 2304 - RNA, 20 nt, Artificial Sequence
  Description of Artificial Sequence: Synthetic oligonucleotide
ccauuggagcuuguaugugu

SEQ ID NO: 2305 - RNA, 20 nt, Artificial Sequence
  Description of Artificial Sequence: Synthetic oligonucleotide
gccauuggagcuuguaugug

SEQ ID NO: 2306 - RNA, 20 nt, Artificial Sequence
  Description of Artificial Sequence: Synthetic oligonucleotide
agccauuggagcuuguaugu

SEQ ID NO: 2307 - RNA, 20 nt, Artificial Sequence
  Description of Artificial Sequence: Synthetic oligonucleotide
cuggaggaagaauugccugg

SEQ ID NO: 2308 - RNA, 20 nt, Artificial Sequence
  Description of Artificial Sequence: Synthetic oligonucleotide
guccuggaggaagaauugcc

SEQ ID NO: 2309 - RNA, 20 nt, Artificial Sequence
  Description of Artificial Sequence: Synthetic oligonucleotide
gccaguaagaagggcaaagu

SEQ ID NO: 2310 - RNA, 20 nt, Artificial Sequence
  Description of Artificial Sequence: Synthetic oligonucleotide
ggccaguaagaagggcaaag

SEQ ID NO: 2311 - RNA, 20 nt, Artificial Sequence
  Description of Artificial Sequence: Synthetic oligonucleotide
ggaaugagucaagccuggac

SEQ ID NO: 2312 - RNA, 20 nt, Artificial Sequence
  Description of Artificial Sequence: Synthetic oligonucleotide
gggaaugagucaagccugga

SEQ ID NO: 2313 - RNA, 20 nt, Artificial Sequence
  Description of Artificial Sequence: Synthetic oligonucleotide
gugggaaugagucaagccug

SEQ ID NO: 2314 - RNA, 20 nt, Artificial Sequence
  Description of Artificial Sequence: Synthetic oligonucleotide
aaggugggaaugagucaagc

SEQ ID NO: 2315 - RNA, 20 nt, Artificial Sequence
  Description of Artificial Sequence: Synthetic oligonucleotide
ucucagcccaggacaaggug

SEQ ID NO: 2316 - RNA, 20 nt, Artificial Sequence
  Description of Artificial Sequence: Synthetic oligonucleotide
aucucagcccaggacaaggu

SEQ ID NO: 2317 - RNA, 20 nt, Artificial Sequence
  Description of Artificial Sequence: Synthetic oligonucleotide
gcugggugguucucuccugu

SEQ ID NO: 2318 - RNA, 20 nt, Artificial Sequence
  Description of Artificial Sequence: Synthetic oligonucleotide
uucugggcugggugguucuc

SEQ ID NO: 2319 - RNA, 20 nt, Artificial Sequence
  Description of Artificial Sequence: Synthetic oligonucleotide
gaacuucugggcuggguggu

SEQ ID NO: 2320 - RNA, 20 nt, Artificial Sequence
  Description of Artificial Sequence: Synthetic oligonucleotide
cggagaguuccuucccugga

SEQ ID NO: 2321 - RNA, 20 nt, Artificial Sequence
  Description of Artificial Sequence: Synthetic oligonucleotide
accggagaguuccuucccug

SEQ ID NO: 2322 - RNA, 20 nt, Artificial Sequence
  Description of Artificial Sequence: Synthetic oligonucleotide
gaccggagaguuccuucccu

SEQ ID NO: 2323 - RNA, 20 nt, Artificial Sequence
  Description of Artificial Sequence: Synthetic oligonucleotide
uggaccggagaguuccuucc

SEQ ID NO: 2324 - RNA, 20 nt, Artificial Sequence
  Description of Artificial Sequence: Synthetic oligonucleotide
guggaccggagaguuccuuc

SEQ ID NO: 2325 - RNA, 20 nt, Artificial Sequence
  Description of Artificial Sequence: Synthetic oligonucleotide
gguggaccggagaguuccuu

SEQ ID NO: 2326 - RNA, 20 nt, Artificial Sequence
  Description of Artificial Sequence: Synthetic oligonucleotide
ugguggaccggagaguuccu

SEQ ID NO: 2327 - RNA, 20 nt, Artificial Sequence
  Description of Artificial Sequence: Synthetic oligonucleotide
augguggaccggagaguucc

SEQ ID NO: 2328 - RNA, 20 nt, Artificial Sequence
  Description of Artificial Sequence: Synthetic oligonucleotide
caugguggaccggagaguuc

SEQ ID NO: 2329 - RNA, 20 nt, Artificial Sequence
  Description of Artificial Sequence: Synthetic oligonucleotide
gagcugagagguacuccaug

SEQ ID NO: 2330 - RNA, 20 nt, Artificial Sequence
  Description of Artificial Sequence: Synthetic oligonucleotide
agagcugagagguacuccau

SEQ ID NO: 2331 - RNA, 20 nt, Artificial Sequence
  Description of Artificial Sequence: Synthetic oligonucleotide
cagagcugagagguacucca

SEQ ID NO: 2332 - RNA, 20 nt, Artificial Sequence
  Description of Artificial Sequence: Synthetic oligonucleotide
uucagagcugagagguacuc

SEQ ID NO: 2333 - RNA, 20 nt, Artificial Sequence
  Description of Artificial Sequence: Synthetic oligonucleotide
gguucagagcugagagguac

SEQ ID NO: 2334 - RNA, 20 nt, Artificial Sequence
  Description of Artificial Sequence: Synthetic oligonucleotide
ggguucagagcugagaggua

SEQ ID NO: 2335 - RNA, 20 nt, Artificial Sequence
  Description of Artificial Sequence: Synthetic oligonucleotide
caccugaguaagucacuggg

SEQ ID NO: 2336 - RNA, 20 nt, Artificial Sequence
  Description of Artificial Sequence: Synthetic oligonucleotide
ucaccugaguaagucacugg

SEQ ID NO: 2337 - RNA, 20 nt, Artificial Sequence
  Description of Artificial Sequence: Synthetic oligonucleotide
gucaccugaguaagucacug

SEQ ID NO: 2338 - RNA, 20 nt, Artificial Sequence
  Description of Artificial Sequence: Synthetic oligonucleotide
agucaccugaguaagucacu

SEQ ID NO: 2339 - RNA, 20 nt, Artificial Sequence
  Description of Artificial Sequence: Synthetic oligonucleotide
cagucaccugaguaagucac

SEQ ID NO: 2340 - RNA, 20 nt, Artificial Sequence
  Description of Artificial Sequence: Synthetic oligonucleotide
gcagucaccugaguaaguca

SEQ ID NO: 2341 - RNA, 20 nt, Artificial Sequence
  Description of Artificial Sequence: Synthetic oligonucleotide
uuagcagucaccugaguaag

SEQ ID NO: 2342 - RNA, 20 nt, Artificial Sequence
  Description of Artificial Sequence: Synthetic oligonucleotide
guuagcagucaccugaguaa

SEQ ID NO: 2343 - RNA, 20 nt, Artificial Sequence
  Description of Artificial Sequence: Synthetic oligonucleotide
gguuagcagucaccugagua

SEQ ID NO: 2344 - RNA, 20 nt, Artificial Sequence
  Description of Artificial Sequence: Synthetic oligonucleotide
ggguuagcagucaccugagu

SEQ ID NO: 2345 - RNA, 20 nt, Artificial Sequence
  Description of Artificial Sequence: Synthetic oligonucleotide
aggguuagcagucaccugag

SEQ ID NO: 2346 - RNA, 20 nt, Artificial Sequence
  Description of Artificial Sequence: Synthetic oligonucleotide
gaggguuagcagucaccuga

SEQ ID NO: 2347 - RNA, 20 nt, Artificial Sequence
  Description of Artificial Sequence: Synthetic oligonucleotide
ggaggguuagcagucaccug

SEQ ID NO: 2348 - RNA, 20 nt, Artificial Sequence
  Description of Artificial Sequence: Synthetic oligonucleotide
cggaggguuagcagucaccu

SEQ ID NO: 2349 - RNA, 20 nt, Artificial Sequence
  Description of Artificial Sequence: Synthetic oligonucleotide
agcggaggguuagcagucac

SEQ ID NO: 2350 - RNA, 20 nt, Artificial Sequence
  Description of Artificial Sequence: Synthetic oligonucleotide
gagcggaggguuagcaguca

SEQ ID NO: 2351 - RNA, 20 nt, Artificial Sequence
  Description of Artificial Sequence: Synthetic oligonucleotide
agagcggaggguuagcaguc

SEQ ID NO: 2352 - RNA, 20 nt, Artificial Sequence
  Description of Artificial Sequence: Synthetic oligonucleotide
uagagcggaggguuagcagu

SEQ ID NO: 2353 - RNA, 20 nt, Artificial Sequence
  Description of Artificial Sequence: Synthetic oligonucleotide
guagagcggaggguuagcag

SEQ ID NO: 2354 - RNA, 20 nt, Artificial Sequence
  Description of Artificial Sequence: Synthetic oligonucleotide
gguagagcggaggguuagca

SEQ ID NO: 2355 - RNA, 20 nt, Artificial Sequence
  Description of Artificial Sequence: Synthetic oligonucleotide
aggguagagcggaggguuag

SEQ ID NO: 2356 - RNA, 20 nt, Artificial Sequence
  Description of Artificial Sequence: Synthetic oligonucleotide
gaggguagagcggaggguua

SEQ ID NO: 2357 - RNA, 20 nt, Artificial Sequence
  Description of Artificial Sequence: Synthetic oligonucleotide
auuguugcccugccuauauc

SEQ ID NO: 2358 - RNA, 20 nt, Artificial Sequence
  Description of Artificial Sequence: Synthetic oligonucleotide
aguauuguugcccugccuau

SEQ ID NO: 2359 - RNA, 20 nt, Artificial Sequence
  Description of Artificial Sequence: Synthetic oligonucleotide
gaguauuguugcccugccua

SEQ ID NO: 2360 - RNA, 20 nt, Artificial Sequence
  Description of Artificial Sequence: Synthetic oligonucleotide
ggaguauuguugcccugccu

SEQ ID NO: 2361 - RNA, 20 nt, Artificial Sequence
  Description of Artificial Sequence: Synthetic oligonucleotide
uggaguauuguugcccugcc

SEQ ID NO: 2362 - RNA, 20 nt, Artificial Sequence
  Description of Artificial Sequence: Synthetic oligonucleotide
guggaguauuguugcccugc

SEQ ID NO: 2363 - RNA, 20 nt, Artificial Sequence
  Description of Artificial Sequence: Synthetic oligonucleotide
aguggaguauuguugcccug

SEQ ID NO: 2364 - RNA, 20 nt, Artificial Sequence
  Description of Artificial Sequence: Synthetic oligonucleotide
gaguggaguauuguugcccu

SEQ ID NO: 2365 - RNA, 20 nt, Artificial Sequence
  Description of Artificial Sequence: Synthetic oligonucleotide
ugaguggaguauuguugccc

SEQ ID NO: 2366 - RNA, 20 nt, Artificial Sequence
  Description of Artificial Sequence: Synthetic oligonucleotide
cugaguggaguauuguugcc

SEQ ID NO: 2367 - RNA, 20 nt, Artificial Sequence
  Description of Artificial Sequence: Synthetic oligonucleotide
gcugaguggaguauuguugc

SEQ ID NO: 2368 - RNA, 20 nt, Artificial Sequence
  Description of Artificial Sequence: Synthetic oligonucleotide
ggcugaguggaguauuguug

SEQ ID NO: 2369 - RNA, 20 nt, Artificial Sequence
  Description of Artificial Sequence: Synthetic oligonucleotide
gggcugaguggaguauuguu

SEQ ID NO: 2370 - RNA, 20 nt, Artificial Sequence
  Description of Artificial Sequence: Synthetic oligonucleotide
gguacugguuagucuccuag

SEQ ID NO: 2371 - RNA, 20 nt, Artificial Sequence
  Description of Artificial Sequence: Synthetic oligonucleotide
ggguacugguuagucuccua

SEQ ID NO: 2372 - RNA, 20 nt, Artificial Sequence
  Description of Artificial Sequence: Synthetic oligonucleotide
uugacaagcccacuguggag

SEQ ID NO: 2373 - RNA, 20 nt, Artificial Sequence
  Description of Artificial Sequence: Synthetic oligonucleotide
uggcucaggagcuugacaag

SEQ ID NO: 2374 - RNA, 20 nt, Artificial Sequence
  Description of Artificial Sequence: Synthetic oligonucleotide
gguggcucaggagcuugaca

SEQ ID NO: 2375 - RNA, 20 nt, Artificial Sequence
  Description of Artificial Sequence: Synthetic oligonucleotide
uagggaugagggagagacca

SEQ ID NO: 2376 - RNA, 20 nt, Artificial Sequence
  Description of Artificial Sequence: Synthetic oligonucleotide
ucgauuagggaugagggaga

SEQ ID NO: 2377 - RNA, 20 nt, Artificial Sequence
  Description of Artificial Sequence: Synthetic oligonucleotide
uagagggcuagggagggaga

SEQ ID NO: 2378 - RNA, 20 nt, Artificial Sequence
  Description of Artificial Sequence: Synthetic oligonucleotide
guagaguggcuagagggcua

SEQ ID NO: 2379 - RNA, 20 nt, Artificial Sequence
  Description of Artificial Sequence: Synthetic oligonucleotide
gguagaguggcuagagggcu

SEQ ID NO: 2380 - RNA, 20 nt, Artificial Sequence
  Description of Artificial Sequence: Synthetic oligonucleotide
ugaggguagaguggcuagag

SEQ ID NO: 2381 - RNA, 20 nt, Artificial Sequence
  Description of Artificial Sequence: Synthetic oligonucleotide
gaugaggguagaguggcuag

SEQ ID NO: 2382 - RNA, 20 nt, Artificial Sequence
  Description of Artificial Sequence: Synthetic oligonucleotide
caugaugaggguagaguggc

SEQ ID NO: 2383 - RNA, 20 nt, Artificial Sequence
  Description of Artificial Sequence: Synthetic oligonucleotide
gcaugaugaggguagagugg

SEQ ID NO: 2384 - RNA, 20 nt, Artificial Sequence
  Description of Artificial Sequence: Synthetic oligonucleotide
gggcaugaugaggguagagu

SEQ ID NO: 2385 - RNA, 20 nt, Artificial Sequence
  Description of Artificial Sequence: Synthetic oligonucleotide
gguaguugagaagaaaaguc

SEQ ID NO: 2386 - RNA, 20 nt, Artificial Sequence
  Description of Artificial Sequence: Synthetic oligonucleotide
ccaaacuccgagcuuauauu

SEQ ID NO: 2387 - RNA, 20 nt, Artificial Sequence
  Description of Artificial Sequence: Synthetic oligonucleotide
uccaaacuccgagcuuauau

SEQ ID NO: 2388 - RNA, 20 nt, Artificial Sequence
  Description of Artificial Sequence: Synthetic oligonucleotide
guccaaacuccgagcuuaua

SEQ ID NO: 2389 - RNA, 20 nt, Artificial Sequence
  Description of Artificial Sequence: Synthetic oligonucleotide
cguccaaacuccgagcuuau

SEQ ID NO: 2390 - RNA, 20 nt, Artificial Sequence
  Description of Artificial Sequence: Synthetic oligonucleotide
ccguccaaacuccgagcuua

SEQ ID NO: 2391 - RNA, 20 nt, Artificial Sequence
  Description of Artificial Sequence: Synthetic oligonucleotide
uccguccaaacuccgagcuu

SEQ ID NO: 2392 - RNA, 20 nt, Artificial Sequence
  Description of Artificial Sequence: Synthetic oligonucleotide
cuccguccaaacuccgagcu

SEQ ID NO: 2393 - RNA, 20 nt, Artificial Sequence
  Description of Artificial Sequence: Synthetic oligonucleotide
acccuccguccaaacuccga

SEQ ID NO: 2394 - RNA, 20 nt, Artificial Sequence
  Description of Artificial Sequence: Synthetic oligonucleotide
agacccuccguccaaacucc

SEQ ID NO: 2395 - RNA, 20 nt, Artificial Sequence
  Description of Artificial Sequence: Synthetic oligonucleotide
cagacccuccguccaaacuc

SEQ ID NO: 2396 - RNA, 20 nt, Artificial Sequence
  Description of Artificial Sequence: Synthetic oligonucleotide
uccagacccuccguccaaac

SEQ ID NO: 2397 - RNA, 20 nt, Artificial Sequence
  Description of Artificial Sequence: Synthetic oligonucleotide
guccagacccuccguccaaa

SEQ ID NO: 2398 - RNA, 20 nt, Artificial Sequence
  Description of Artificial Sequence: Synthetic oligonucleotide
agacacggaaaggucgcugg

SEQ ID NO: 2399 - RNA, 20 nt, Artificial Sequence
  Description of Artificial Sequence: Synthetic oligonucleotide
cagacacggaaaggucgcug

SEQ ID NO: 2400 - RNA, 20 nt, Artificial Sequence
  Description of Artificial Sequence: Synthetic oligonucleotide
acagacacggaaaggucgcu

SEQ ID NO: 2401 - RNA, 20 nt, Artificial Sequence
  Description of Artificial Sequence: Synthetic oligonucleotide
cacagacacggaaaggucgc

SEQ ID NO: 2402 - RNA, 20 nt, Artificial Sequence
  Description of Artificial Sequence: Synthetic oligonucleotide
ucacagacacggaaaggucg

SEQ ID NO: 2403 - RNA, 20 nt, Artificial Sequence
  Description of Artificial Sequence: Synthetic oligonucleotide
aucacagacacggaaagguc

SEQ ID NO: 2404 - RNA, 20 nt, Artificial Sequence
  Description of Artificial Sequence: Synthetic oligonucleotide
gaucacagacacggaaaggu

SEQ ID NO: 2405 - RNA, 20 nt, Artificial Sequence
  Description of Artificial Sequence: Synthetic oligonucleotide
uuggccuacuuacuuuggcu

SEQ ID NO: 2406 - RNA, 20 nt, Artificial Sequence
  Description of Artificial Sequence: Synthetic oligonucleotide
cuuggccuacuuacuuuggc

SEQ ID NO: 2407 - RNA, 20 nt, Artificial Sequence
  Description of Artificial Sequence: Synthetic oligonucleotide
acuuggccuacuuacuuugg

SEQ ID NO: 2408 - RNA, 20 nt, Artificial Sequence
  Description of Artificial Sequence: Synthetic oligonucleotide
gaggaacuuggccuacuuac

SEQ ID NO: 2409 - RNA, 20 nt, Artificial Sequence
  Description of Artificial Sequence: Synthetic oligonucleotide
cgaggaacuuggccuacuua

SEQ ID NO: 2410 - RNA, 20 nt, Artificial Sequence
  Description of Artificial Sequence: Synthetic oligonucleotide
ccgaggaacuuggccuacuu

SEQ ID NO: 2411 - RNA, 20 nt, Artificial Sequence
  Description of Artificial Sequence: Synthetic oligonucleotide
accgaggaacuuggccuacu

SEQ ID NO: 2412 - RNA, 20 nt, Artificial Sequence
  Description of Artificial Sequence: Synthetic oligonucleotide
aaccgaggaacuuggccuac

SEQ ID NO: 2413 - RNA, 20 nt, Artificial Sequence
  Description of Artificial Sequence: Synthetic oligonucleotide
gaaccgaggaacuuggccua

SEQ ID NO: 2414 - RNA, 20 nt, Artificial Sequence
  Description of Artificial Sequence: Synthetic oligonucleotide
ggaaccgaggaacuuggccu

SEQ ID NO: 2415 - RNA, 20 nt, Artificial Sequence
  Description of Artificial Sequence: Synthetic oligonucleotide
aggaaccgaggaacuuggcc

SEQ ID NO: 2416 - RNA, 20 nt, Artificial Sequence
  Description of Artificial Sequence: Synthetic oligonucleotide
uaggaaccgaggaacuuggc

SEQ ID NO: 2417 - RNA, 20 nt, Artificial Sequence
  Description of Artificial Sequence: Synthetic oligonucleotide
auaggaaccgaggaacuugg

SEQ ID NO: 2418 - RNA, 20 nt, Artificial Sequence
  Description of Artificial Sequence: Synthetic oligonucleotide
uauaggaaccgaggaacuug

SEQ ID NO: 2419 - RNA, 20 nt, Artificial Sequence
  Description of Artificial Sequence: Synthetic oligonucleotide
aucacaaguugccacuguug

SEQ ID NO: 2420 - RNA, 20 nt, Artificial Sequence
  Description of Artificial Sequence: Synthetic oligonucleotide
caucacaaguugccacuguu

SEQ ID NO: 2421 - RNA, 20 nt, Artificial Sequence
  Description of Artificial Sequence: Synthetic oligonucleotide
aucaucacaaguugccacug

SEQ ID NO: 2422 - RNA, 20 nt, Artificial Sequence
  Description of Artificial Sequence: Synthetic oligonucleotide
caucaucacaaguugccacu

SEQ ID NO: 2423 - RNA, 20 nt, Artificial Sequence
  Description of Artificial Sequence: Synthetic oligonucleotide
cugcuccaucaucacaaguu

SEQ ID NO: 2424 - RNA, 20 nt, Artificial Sequence
  Description of Artificial Sequence: Synthetic oligonucleotide
ucugcuccaucaucacaagu

SEQ ID NO: 2425 - RNA, 20 nt, Artificial Sequence
  Description of Artificial Sequence: Synthetic oligonucleotide
cccucugcuccaucaucaca

SEQ ID NO: 2426 - RNA, 20 nt, Artificial Sequence
  Description of Artificial Sequence: Synthetic oligonucleotide
ucagcccucugcuccaucau

SEQ ID NO: 2427 - RNA, 20 nt, Artificial Sequence
  Description of Artificial Sequence: Synthetic oligonucleotide
ugacuucagcccucugcucc

SEQ ID NO: 2428 - RNA, 20 nt, Artificial Sequence
  Description of Artificial Sequence: Synthetic oligonucleotide
gugacuucagcccucugcuc

SEQ ID NO: 2429 - RNA, 20 nt, Artificial Sequence
  Description of Artificial Sequence: Synthetic oligonucleotide
ugugacuucagcccucugcu

SEQ ID NO: 2430 - RNA, 20 nt, Artificial Sequence
  Description of Artificial Sequence: Synthetic oligonucleotide
gugugacuucagcccucugc

SEQ ID NO: 2431 - RNA, 20 nt, Artificial Sequence
  Description of Artificial Sequence: Synthetic oligonucleotide
ugugugacuucagcccucug

SEQ ID NO: 2432 - RNA, 20 nt, Artificial Sequence
  Description of Artificial Sequence: Synthetic oligonucleotide
gcccacuccgcugcuuuuag

SEQ ID NO: 2433 - RNA, 20 nt, Artificial Sequence
  Description of Artificial Sequence: Synthetic oligonucleotide
ggcccacuccgcugcuuuua

SEQ ID NO: 2434 - RNA, 20 nt, Artificial Sequence
  Description of Artificial Sequence: Synthetic oligonucleotide
aggcccacuccgcugcuuuu

SEQ ID NO: 2435 - RNA, 20 nt, Artificial Sequence
  Description of Artificial Sequence: Synthetic oligonucleotide
uaggcccacuccgcugcuuu

SEQ ID NO: 2436 - RNA, 20 nt, Artificial Sequence
  Description of Artificial Sequence: Synthetic oligonucleotide
uuaggcccacuccgcugcuu

SEQ ID NO: 2437 - RNA, 20 nt, Artificial Sequence
  Description of Artificial Sequence: Synthetic oligonucleotide
auuaggcccacuccgcugcu

SEQ ID NO: 2438 - RNA, 20 nt, Artificial Sequence
  Description of Artificial Sequence: Synthetic oligonucleotide
ucauuaggcccacuccgcug

SEQ ID NO: 2439 - RNA, 20 nt, Artificial Sequence
  Description of Artificial Sequence: Synthetic oligonucleotide
cucauuaggcccacuccgcu

SEQ ID NO: 2440 - RNA, 20 nt, Artificial Sequence
  Description of Artificial Sequence: Synthetic oligonucleotide
agcucauuaggcccacuccg

SEQ ID NO: 2441 - RNA, 20 nt, Artificial Sequence
  Description of Artificial Sequence: Synthetic oligonucleotide
cucccauagaaaagcucacu

SEQ ID NO: 2442 - RNA, 20 nt, Artificial Sequence
  Description of Artificial Sequence: Synthetic oligonucleotide
gcucccauagaaaagcucac

SEQ ID NO: 2443 - RNA, 20 nt, Artificial Sequence
  Description of Artificial Sequence: Synthetic oligonucleotide
ugcucccauagaaaagcuca

SEQ ID NO: 2444 - RNA, 20 nt, Artificial Sequence
  Description of Artificial Sequence: Synthetic oligonucleotide
cugcucccauagaaaagcuc

SEQ ID NO: 2445 - RNA, 20 nt, Artificial Sequence
  Description of Artificial Sequence: Synthetic oligonucleotide
ccugcucccauagaaaagcu

SEQ ID NO: 2446 - RNA, 20 nt, Artificial Sequence
  Description of Artificial Sequence: Synthetic oligonucleotide
ucccuaucuccugcuaaccc

SEQ ID NO: 2447 - RNA, 20 nt, Artificial Sequence
  Description of Artificial Sequence: Synthetic oligonucleotide
ccucgaacucucccuaucuc

SEQ ID NO: 2448 - RNA, 20 nt, Artificial Sequence
  Description of Artificial Sequence: Synthetic oligonucleotide
cccucgaacucucccuaucu

SEQ ID NO: 2449 - RNA, 20 nt, Artificial Sequence
  Description of Artificial Sequence: Synthetic oligonucleotide
ucccucgaacucucccuauc

SEQ ID NO: 2450 - RNA, 20 nt, Artificial Sequence
  Description of Artificial Sequence: Synthetic oligonucleotide
gucccucgaacucucccuau

SEQ ID NO: 2451 - RNA, 20 nt, Artificial Sequence
  Description of Artificial Sequence: Synthetic oligonucleotide
cuuuccauacuagcuucuga

SEQ ID NO: 2452 - RNA, 20 nt, Artificial Sequence
  Description of Artificial Sequence: Synthetic oligonucleotide
ccuuuccauacuagcuucug

SEQ ID NO: 2453 - RNA, 20 nt, Artificial Sequence
  Description of Artificial Sequence: Synthetic oligonucleotide
accuuuccauacuagcuucu

SEQ ID NO: 2454 - RNA, 20 nt, Artificial Sequence
  Description of Artificial Sequence: Synthetic oligonucleotide
cacacaaaucaccuuuccau

SEQ ID NO: 2455 - RNA, 20 nt, Artificial Sequence
  Description of Artificial Sequence: Synthetic oligonucleotide
gucacacaaaucaccuuucc

SEQ ID NO: 2456 - RNA, 20 nt, Artificial Sequence
  Description of Artificial Sequence: Synthetic oligonucleotide
ugucacacaaaucaccuuuc

SEQ ID NO: 2457 - RNA, 20 nt, Artificial Sequence
  Description of Artificial Sequence: Synthetic oligonucleotide
uuugacaggcaggaaguggc

SEQ ID NO: 2458 - RNA, 20 nt, Artificial Sequence
  Description of Artificial Sequence: Synthetic oligonucleotide
gguuugacaggcaggaagug

SEQ ID NO: 2459 - RNA, 20 nt, Artificial Sequence
  Description of Artificial Sequence: Synthetic oligonucleotide
agguuugacaggcaggaagu

SEQ ID NO: 2460 - RNA, 20 nt, Artificial Sequence
  Description of Artificial Sequence: Synthetic oligonucleotide
aagguuugacaggcaggaag

SEQ ID NO: 2461 - RNA, 20 nt, Artificial Sequence
  Description of Artificial Sequence: Synthetic oligonucleotide
aacuucccaagguuugacag

SEQ ID NO: 2462 - RNA, 20 nt, Artificial Sequence
  Description of Artificial Sequence: Synthetic oligonucleotide
caacuucccaagguuugaca

SEQ ID NO: 2463 - RNA, 20 nt, Artificial Sequence
  Description of Artificial Sequence: Synthetic oligonucleotide
gaacaacuucccaagguuug

SEQ ID NO: 2464 - RNA, 20 nt, Artificial Sequence
  Description of Artificial Sequence: Synthetic oligonucleotide
ugaacaacuucccaagguuu

SEQ ID NO: 2465 - RNA, 20 nt, Artificial Sequence
  Description of Artificial Sequence: Synthetic oligonucleotide
guagguugaacaacuuccca

SEQ ID NO: 2466 - RNA, 20 nt, Artificial Sequence
  Description of Artificial Sequence: Synthetic oligonucleotide
gguagguugaacaacuuccc

SEQ ID NO: 2467 - RNA, 20 nt, Artificial Sequence
  Description of Artificial Sequence: Synthetic oligonucleotide
ugguagguugaacaacuucc

SEQ ID NO: 2468 - RNA, 20 nt, Artificial Sequence
  Description of Artificial Sequence: Synthetic oligonucleotide
gguuuugguagguugaacaa

SEQ ID NO: 2469 - RNA, 20 nt, Artificial Sequence
  Description of Artificial Sequence: Synthetic oligonucleotide
ugagguuuugguagguugaa

SEQ ID NO: 2470 - RNA, 20 nt, Artificial Sequence
  Description of Artificial Sequence: Synthetic oligonucleotide
cugagguuuugguagguuga

SEQ ID NO: 2471 - RNA, 20 nt, Artificial Sequence
  Description of Artificial Sequence: Synthetic oligonucleotide
ccuacauuauccucuuacuc

SEQ ID NO: 2472 - RNA, 20 nt, Artificial Sequence
  Description of Artificial Sequence: Synthetic oligonucleotide
ggacuuuaccuacauuaucc

SEQ ID NO: 2473 - RNA, 20 nt, Artificial Sequence
  Description of Artificial Sequence: Synthetic oligonucleotide
guaugaggacuuuaccuaca

SEQ ID NO: 2474 - RNA, 20 nt, Artificial Sequence
  Description of Artificial Sequence: Synthetic oligonucleotide
gccagguaugaggacuuuac

SEQ ID NO: 2475 - RNA, 20 nt, Artificial Sequence
  Description of Artificial Sequence: Synthetic oligonucleotide
ugccagguaugaggacuuua

SEQ ID NO: 2476 - RNA, 20 nt, Artificial Sequence
  Description of Artificial Sequence: Synthetic oligonucleotide
gugccagguaugaggacuuu

SEQ ID NO: 2477 - RNA, 20 nt, Artificial Sequence
  Description of Artificial Sequence: Synthetic oligonucleotide
cugugccagguaugaggacu

SEQ ID NO: 2478 - RNA, 20 nt, Artificial Sequence
  Description of Artificial Sequence: Synthetic oligonucleotide
ucugugccagguaugaggac

SEQ ID NO: 2479 - RNA, 20 nt, Artificial Sequence
  Description of Artificial Sequence: Synthetic oligonucleotide
ccucaagaguucuccagaag

SEQ ID NO: 2480 - RNA, 20 nt, Artificial Sequence
  Description of Artificial Sequence: Synthetic oligonucleotide
cccucaagaguucuccagaa

SEQ ID NO: 2481 - RNA, 20 nt, Artificial Sequence
  Description of Artificial Sequence: Synthetic oligonucleotide
acccucaagaguucuccaga

SEQ ID NO: 2482 - RNA, 20 nt, Artificial Sequence
  Description of Artificial Sequence: Synthetic oligonucleotide
acacccucaagaguucucca

SEQ ID NO: 2483 - RNA, 20 nt, Artificial Sequence
  Description of Artificial Sequence: Synthetic oligonucleotide
cacacccucaagaguucucc

SEQ ID NO: 2484 - RNA, 20 nt, Artificial Sequence
  Description of Artificial Sequence: Synthetic oligonucleotide
ccacacccucaagaguucuc

SEQ ID NO: 2485 - RNA, 20 nt, Artificial Sequence
  Description of Artificial Sequence: Synthetic oligonucleotide
cccacacccucaagaguucu

SEQ ID NO: 2486 - RNA, 20 nt, Artificial Sequence
  Description of Artificial Sequence: Synthetic oligonucleotide
uucccacacccucaagaguu

SEQ ID NO: 2487 - RNA, 20 nt, Artificial Sequence
  Description of Artificial Sequence: Synthetic oligonucleotide
caaugcugcaccucacuucc

SEQ ID NO: 2488 - RNA, 20 nt, Artificial Sequence
  Description of Artificial Sequence: Synthetic oligonucleotide
uacaaugcugcaccucacuu

SEQ ID NO: 2489 - RNA, 20 nt, Artificial Sequence
  Description of Artificial Sequence: Synthetic oligonucleotide
cuacaaugcugcaccucacu

SEQ ID NO: 2490 - RNA, 20 nt, Artificial Sequence
  Description of Artificial Sequence: Synthetic oligonucleotide
ucuacaaugcugcaccucac

SEQ ID NO: 2491 - RNA, 20 nt, Artificial Sequence
  Description of Artificial Sequence: Synthetic oligonucleotide
aucuacaaugcugcaccuca

SEQ ID NO: 2492 - RNA, 20 nt, Artificial Sequence
  Description of Artificial Sequence: Synthetic oligonucleotide
uaucuacaaugcugcaccuc

SEQ ID NO: 2493 - RNA, 20 nt, Artificial Sequence
  Description of Artificial Sequence: Synthetic oligonucleotide
cuuaucuacaaugcugcacc

SEQ ID NO: 2494 - RNA, 20 nt, Artificial Sequence
  Description of Artificial Sequence: Synthetic oligonucleotide
gucuuaucuacaaugcugca

SEQ ID NO: 2495 - RNA, 20 nt, Artificial Sequence
  Description of Artificial Sequence: Synthetic oligonucleotide
ugucuuaucuacaaugcugc

SEQ ID NO: 2496 - RNA, 20 nt, Artificial Sequence
  Description of Artificial Sequence: Synthetic oligonucleotide
cugucuuaucuacaaugcug

SEQ ID NO: 2497 - RNA, 20 nt, Artificial Sequence
  Description of Artificial Sequence: Synthetic oligonucleotide
cacccuucugucuuaucuac

SEQ ID NO: 2498 - RNA, 20 nt, Artificial Sequence
  Description of Artificial Sequence: Synthetic oligonucleotide
uccacccuucugucuuaucu

SEQ ID NO: 2499 - RNA, 20 nt, Artificial Sequence
  Description of Artificial Sequence: Synthetic oligonucleotide
guccacccuucugucuuauc

SEQ ID NO: 2500 - RNA, 20 nt, Artificial Sequence
  Description of Artificial Sequence: Synthetic oligonucleotide
aguccacccuucugucuuau

SEQ ID NO: 2501 - RNA, 20 nt, Artificial Sequence
  Description of Artificial Sequence: Synthetic oligonucleotide
aaguccacccuucugucuua

SEQ ID NO: 2502 - RNA, 20 nt, Artificial Sequence
  Description of Artificial Sequence: Synthetic oligonucleotide
gaaagcaagccagguucuca

SEQ ID NO: 2503 - RNA, 20 nt, Artificial Sequence
  Description of Artificial Sequence: Synthetic oligonucleotide
ggaaagcaagccagguucuc

SEQ ID NO: 2504 - RNA, 20 nt, Artificial Sequence
  Description of Artificial Sequence: Synthetic oligonucleotide
ggaauuggaaagcaagccag

SEQ ID NO: 2505 - RNA, 20 nt, Artificial Sequence
  Description of Artificial Sequence: Synthetic oligonucleotide
accaugucauuggcaucucc

SEQ ID NO: 2506 - RNA, 20 nt, Artificial Sequence
  Description of Artificial Sequence: Synthetic oligonucleotide
uaccaugucauuggcaucuc

SEQ ID NO: 2507 - RNA, 20 nt, Artificial Sequence
  Description of Artificial Sequence: Synthetic oligonucleotide
ccuaccaugucauuggcauc

SEQ ID NO: 2508 - RNA, 20 nt, Artificial Sequence
  Description of Artificial Sequence: Synthetic oligonucleotide
uccuaccaugucauuggcau

SEQ ID NO: 2509 - RNA, 20 nt, Artificial Sequence
  Description of Artificial Sequence: Synthetic oligonucleotide
cuccuaccaugucauuggca

SEQ ID NO: 2510 - RNA, 20 nt, Artificial Sequence
  Description of Artificial Sequence: Synthetic oligonucleotide
gcuccuaccaugucauuggc

SEQ ID NO: 2511 - RNA, 20 nt, Artificial Sequence
  Description of Artificial Sequence: Synthetic oligonucleotide
ugcuccuaccaugucauugg

SEQ ID NO: 2512 - RNA, 20 nt, Artificial Sequence
  Description of Artificial Sequence: Synthetic oligonucleotide
ucuuugcuccuaccauguca

SEQ ID NO: 2513 - RNA, 20 nt, Artificial Sequence
  Description of Artificial Sequence: Synthetic oligonucleotide
ccucuuugcuccuaccaugu

SEQ ID NO: 2514 - RNA, 20 nt, Artificial Sequence
  Description of Artificial Sequence: Synthetic oligonucleotide
uuccucuuugcuccuaccau

SEQ ID NO: 2515 - RNA, 20 nt, Artificial Sequence
  Description of Artificial Sequence: Synthetic oligonucleotide
ucuccguguucuucaguuuu

SEQ ID NO: 2516 - RNA, 20 nt, Artificial Sequence
  Description of Artificial Sequence: Synthetic oligonucleotide
cucuccguguucuucaguuu

SEQ ID NO: 2517 - RNA, 20 nt, Artificial Sequence
  Description of Artificial Sequence: Synthetic oligonucleotide
agcucuccguguucuucagu

SEQ ID NO: 2518 - RNA, 20 nt, Artificial Sequence
  Description of Artificial Sequence: Synthetic oligonucleotide
ugcagcucuccguguucuuc

SEQ ID NO: 2519 - RNA, 20 nt, Artificial Sequence
  Description of Artificial Sequence: Synthetic oligonucleotide
gguugcagcucuccguguuc

SEQ ID NO: 2520 - RNA, 20 nt, Artificial Sequence
  Description of Artificial Sequence: Synthetic oligonucleotide
agguugcagcucuccguguu

SEQ ID NO: 2521 - RNA, 20 nt, Artificial Sequence
  Description of Artificial Sequence: Synthetic oligonucleotide
aaagguugcagcucuccgug

SEQ ID NO: 2522 - RNA, 20 nt, Artificial Sequence
  Description of Artificial Sequence: Synthetic oligonucleotide
uaaagguugcagcucuccgu

SEQ ID NO: 2523 - RNA, 20 nt, Artificial Sequence
  Description of Artificial Sequence: Synthetic oligonucleotide
cuaaagguugcagcucuccg

SEQ ID NO: 2524 - RNA, 20 nt, Artificial Sequence
  Description of Artificial Sequence: Synthetic oligonucleotide
ccuaaagguugcagcucucc

SEQ ID NO: 2525 - RNA, 20 nt, Artificial Sequence
  Description of Artificial Sequence: Synthetic oligonucleotide
uccuaaagguugcagcucuc

SEQ ID NO: 2526 - RNA, 20 nt, Artificial Sequence
  Description of Artificial Sequence: Synthetic oligonucleotide
cuccuaaagguugcagcucu

SEQ ID NO: 2527 - RNA, 20 nt, Artificial Sequence
  Description of Artificial Sequence: Synthetic oligonucleotide
ccuccuaaagguugcagcuc

SEQ ID NO: 2528 - RNA, 20 nt, Artificial Sequence
  Description of Artificial Sequence: Synthetic oligonucleotide
gcacuuugauaccuccuaaa

SEQ ID NO: 2529 - RNA, 20 nt, Artificial Sequence
  Description of Artificial Sequence: Synthetic oligonucleotide
ggcacuuugauaccuccuaa

SEQ ID NO: 2530 - RNA, 20 nt, Artificial Sequence
  Description of Artificial Sequence: Synthetic oligonucleotide
gaugucccacuuugacuuuc

SEQ ID NO: 2531 - RNA, 20 nt, Artificial Sequence
  Description of Artificial Sequence: Synthetic oligonucleotide
ucgaugucccacuuugacuu

SEQ ID NO: 2532 - RNA, 20 nt, Artificial Sequence
  Description of Artificial Sequence: Synthetic oligonucleotide
gucgaugucccacuuugacu

SEQ ID NO: 2533 - RNA, 20 nt, Artificial Sequence
  Description of Artificial Sequence: Synthetic oligonucleotide
ggucgaugucccacuuugac

SEQ ID NO: 2534 - RNA, 20 nt, Artificial Sequence
  Description of Artificial Sequence: Synthetic oligonucleotide
uggucgaugucccacuuuga

SEQ ID NO: 2535 - RNA, 20 nt, Artificial Sequence
  Description of Artificial Sequence: Synthetic oligonucleotide
uuggucgaugucccacuuug

SEQ ID NO: 2536 - RNA, 20 nt, Artificial Sequence
  Description of Artificial Sequence: Synthetic oligonucleotide
auuggucgaugucccacuuu

SEQ ID NO: 2537 - RNA, 20 nt, Artificial Sequence
  Description of Artificial Sequence: Synthetic oligonucleotide
cauuggucgaugucccacuu

SEQ ID NO: 2538 - RNA, 20 nt, Artificial Sequence
  Description of Artificial Sequence: Synthetic oligonucleotide
aacauccaucaguuggcucu

SEQ ID NO: 2539 - RNA, 20 nt, Artificial Sequence
  Description of Artificial Sequence: Synthetic oligonucleotide
cugcccaacauccaucaguu

SEQ ID NO: 2540 - RNA, 20 nt, Artificial Sequence
  Description of Artificial Sequence: Synthetic oligonucleotide
agcugcccaacauccaucag

SEQ ID NO: 2541 - RNA, 20 nt, Artificial Sequence
  Description of Artificial Sequence: Synthetic oligonucleotide
uagcugcccaacauccauca

SEQ ID NO: 2542 - RNA, 20 nt, Artificial Sequence
  Description of Artificial Sequence: Synthetic oligonucleotide
uuagcugcccaacauccauc

SEQ ID NO: 2543 - RNA, 20 nt, Artificial Sequence
  Description of Artificial Sequence: Synthetic oligonucleotide
uuuagcugcccaacauccau

SEQ ID NO: 2544 - RNA, 20 nt, Artificial Sequence
  Description of Artificial Sequence: Synthetic oligonucleotide
cuuuagcugcccaacaucca

SEQ ID NO: 2545 - RNA, 20 nt, Artificial Sequence
  Description of Artificial Sequence: Synthetic oligonucleotide
ccucuuuagcugcccaacau

SEQ ID NO: 2546 - RNA, 20 nt, Artificial Sequence
  Description of Artificial Sequence: Synthetic oligonucleotide
cccucuuuagcugcccaaca

SEQ ID NO: 2547 - RNA, 20 nt, Artificial Sequence
  Description of Artificial Sequence: Synthetic oligonucleotide
ucccucuuuagcugcccaac

SEQ ID NO: 2548 - RNA, 20 nt, Artificial Sequence
  Description of Artificial Sequence: Synthetic oligonucleotide
uucccucuuuagcugcccaa

SEQ ID NO: 2549 - RNA, 20 nt, Artificial Sequence
  Description of Artificial Sequence: Synthetic oligonucleotide
ccuucccucuuuagcugccc

SEQ ID NO: 2550 - RNA, 20 nt, Artificial Sequence
  Description of Artificial Sequence: Synthetic oligonucleotide
cccuucccucuuuagcugcc

SEQ ID NO: 2551 - RNA, 20 nt, Artificial Sequence
  Description of Artificial Sequence: Synthetic oligonucleotide
gcaggucuuaucccaugccc

SEQ ID NO: 2552 - RNA, 20 nt, Artificial Sequence
  Description of Artificial Sequence: Synthetic oligonucleotide
gggcaggucuuaucccaugc

SEQ ID NO: 2553 - RNA, 20 nt, Artificial Sequence
  Description of Artificial Sequence: Synthetic oligonucleotide
agggcaggucuuaucccaug

SEQ ID NO: 2554 - RNA, 20 nt, Artificial Sequence
  Description of Artificial Sequence: Synthetic oligonucleotide
aagggcaggucuuaucccau

SEQ ID NO: 2555 - RNA, 20 nt, Artificial Sequence
  Description of Artificial Sequence: Synthetic oligonucleotide
gaagggcaggucuuauccca

SEQ ID NO: 2556 - RNA, 20 nt, Artificial Sequence
  Description of Artificial Sequence: Synthetic oligonucleotide
agaagggcaggucuuauccc

SEQ ID NO: 2557 - RNA, 20 nt, Artificial Sequence
  Description of Artificial Sequence: Synthetic oligonucleotide
ccaauggcaagaagcaagaa

SEQ ID NO: 2558 - RNA, 20 nt, Artificial Sequence
  Description of Artificial Sequence: Synthetic oligonucleotide
cccaauggcaagaagcaaga

SEQ ID NO: 2559 - RNA, 20 nt, Artificial Sequence
  Description of Artificial Sequence: Synthetic oligonucleotide
gcccaauggcaagaagcaag

SEQ ID NO: 2560 - RNA, 20 nt, Artificial Sequence
  Description of Artificial Sequence: Synthetic oligonucleotide
uccaaugccugcccaauggc

SEQ ID NO: 2561 - RNA, 20 nt, Artificial Sequence
  Description of Artificial Sequence: Synthetic oligonucleotide
cuccaaugccugcccaaugg

SEQ ID NO: 2562 - RNA, 20 nt, Artificial Sequence
  Description of Artificial Sequence: Synthetic oligonucleotide
ucuccaaugccugcccaaug

SEQ ID NO: 2563 - RNA, 20 nt, Artificial Sequence
  Description of Artificial Sequence: Synthetic oligonucleotide
ggucuccaaugccugcccaa

SEQ ID NO: 2564 - RNA, 20 nt, Artificial Sequence
  Description of Artificial Sequence: Synthetic oligonucleotide
uagggucuccaaugccugcc

SEQ ID NO: 2565 - RNA, 20 nt, Artificial Sequence
  Description of Artificial Sequence: Synthetic oligonucleotide
guagggucuccaaugccugc

SEQ ID NO: 2566 - RNA, 20 nt, Artificial Sequence
  Description of Artificial Sequence: Synthetic oligonucleotide
aguagggucuccaaugccug

SEQ ID NO: 2567 - RNA, 20 nt, Artificial Sequence
  Description of Artificial Sequence: Synthetic oligonucleotide
caguagggucuccaaugccu

SEQ ID NO: 2568 - RNA, 20 nt, Artificial Sequence
  Description of Artificial Sequence: Synthetic oligonucleotide
gcaguagggucuccaaugcc

SEQ ID NO: 2569 - RNA, 20 nt, Artificial Sequence
  Description of Artificial Sequence: Synthetic oligonucleotide
agcaguagggucuccaaugc

SEQ ID NO: 2570 - RNA, 20 nt, Artificial Sequence
  Description of Artificial Sequence: Synthetic oligonucleotide
cagcaguagggucuccaaug

SEQ ID NO: 2571 - RNA, 20 nt, Artificial Sequence
  Description of Artificial Sequence: Synthetic oligonucleotide
ucagcaguagggucuccaau

SEQ ID NO: 2572 - RNA, 20 nt, Artificial Sequence
  Description of Artificial Sequence: Synthetic oligonucleotide
auucagcaguagggucucca

SEQ ID NO: 2573 - RNA, 20 nt, Artificial Sequence
  Description of Artificial Sequence: Synthetic oligonucleotide
cauucagcaguagggucucc

SEQ ID NO: 2574 - RNA, 20 nt, Artificial Sequence
  Description of Artificial Sequence: Synthetic oligonucleotide
ccauucagcaguagggucuc

SEQ ID NO: 2575 - RNA, 20 nt, Artificial Sequence
  Description of Artificial Sequence: Synthetic oligonucleotide
uccauucagcaguagggucu

SEQ ID NO: 2576 - RNA, 20 nt, Artificial Sequence
  Description of Artificial Sequence: Synthetic oligonucleotide
acuccauucagcaguagggu

SEQ ID NO: 2577 - RNA, 20 nt, Artificial Sequence
  Description of Artificial Sequence: Synthetic oligonucleotide
cacuccauucagcaguaggg

SEQ ID NO: 2578 - RNA, 20 nt, Artificial Sequence
  Description of Artificial Sequence: Synthetic oligonucleotide
gcacuccauucagcaguagg

SEQ ID NO: 2579 - RNA, 20 nt, Artificial Sequence
  Description of Artificial Sequence: Synthetic oligonucleotide
agcacuccauucagcaguag

SEQ ID NO: 2580 - RNA, 20 nt, Artificial Sequence
  Description of Artificial Sequence: Synthetic oligonucleotide
uagcacuccauucagcagua

SEQ ID NO: 2581 - RNA, 20 nt, Artificial Sequence
  Description of Artificial Sequence: Synthetic oligonucleotide
guuagcacuccauucagcag

SEQ ID NO: 2582 - RNA, 20 nt, Artificial Sequence
  Description of Artificial Sequence: Synthetic oligonucleotide
gguuagcacuccauucagca

SEQ ID NO: 2583 - RNA, 20 nt, Artificial Sequence
  Description of Artificial Sequence: Synthetic oligonucleotide
ggguuagcacuccauucagc

SEQ ID NO: 2584 - RNA, 20 nt, Artificial Sequence
  Description of Artificial Sequence: Synthetic oligonucleotide
caggguuagcacuccauuca

SEQ ID NO: 2585 - RNA, 20 nt, Artificial Sequence
  Description of Artificial Sequence: Synthetic oligonucleotide
ccaggguuagcacuccauuc

SEQ ID NO: 2586 - RNA, 20 nt, Artificial Sequence
  Description of Artificial Sequence: Synthetic oligonucleotide
accaggguuagcacuccauu

SEQ ID NO: 2587 - RNA, 20 nt, Artificial Sequence
  Description of Artificial Sequence: Synthetic oligonucleotide
caccaggguuagcacuccau

SEQ ID NO: 2588 - RNA, 20 nt, Artificial Sequence
  Description of Artificial Sequence: Synthetic oligonucleotide
gcaccaggguuagcacucca

SEQ ID NO: 2589 - RNA, 20 nt, Artificial Sequence
  Description of Artificial Sequence: Synthetic oligonucleotide
agcaccaggguuagcacucc

SEQ ID NO: 2590 - RNA, 20 nt, Artificial Sequence
  Description of Artificial Sequence: Synthetic oligonucleotide
uagcaccaggguuagcacuc

SEQ ID NO: 2591 - RNA, 20 nt, Artificial Sequence
  Description of Artificial Sequence: Synthetic oligonucleotide
cuagcaccaggguuagcacu

SEQ ID NO: 2592 - RNA, 20 nt, Artificial Sequence
  Description of Artificial Sequence: Synthetic oligonucleotide
ucuagcaccaggguuagcac

SEQ ID NO: 2593 - RNA, 20 nt, Artificial Sequence
  Description of Artificial Sequence: Synthetic oligonucleotide
cucuagcaccaggguuagca

SEQ ID NO: 2594 - RNA, 20 nt, Artificial Sequence
  Description of Artificial Sequence: Synthetic oligonucleotide
ccucuagcaccaggguuagc

SEQ ID NO: 2595 - RNA, 20 nt, Artificial Sequence
  Description of Artificial Sequence: Synthetic oligonucleotide
uccucuagcaccaggguuag

SEQ ID NO: 2596 - RNA, 20 nt, Artificial Sequence
  Description of Artificial Sequence: Synthetic oligonucleotide
cuccucuagcaccaggguua

SEQ ID NO: 2597 - RNA, 20 nt, Artificial Sequence
  Description of Artificial Sequence: Synthetic oligonucleotide
ccuccucuagcaccaggguu

SEQ ID NO: 2598 - RNA, 20 nt, Artificial Sequence
  Description of Artificial Sequence: Synthetic oligonucleotide
uccuccucuagcaccagggu

SEQ ID NO: 2599 - RNA, 20 nt, Artificial Sequence
  Description of Artificial Sequence: Synthetic oligonucleotide
guuccauccuccucuagcac

SEQ ID NO: 2600 - RNA, 20 nt, Artificial Sequence
  Description of Artificial Sequence: Synthetic oligonucleotide
aaguccucacuguccacugc

SEQ ID NO: 2601 - RNA, 20 nt, Artificial Sequence
  Description of Artificial Sequence: Synthetic oligonucleotide
gaaguccucacuguccacug

SEQ ID NO: 2602 - RNA, 20 nt, Artificial Sequence
  Description of Artificial Sequence: Synthetic oligonucleotide
agaaguccucacuguccacu

SEQ ID NO: 2603 - RNA, 20 nt, Artificial Sequence
  Description of Artificial Sequence: Synthetic oligonucleotide
aagaaguccucacuguccac

SEQ ID NO: 2604 - RNA, 20 nt, Artificial Sequence
  Description of Artificial Sequence: Synthetic oligonucleotide
gaagaaguccucacugucca

SEQ ID NO: 2605 - RNA, 20 nt, Artificial Sequence
  Description of Artificial Sequence: Synthetic oligonucleotide
ggaagaaguccucacugucc

SEQ ID NO: 2606 - RNA, 20 nt, Artificial Sequence
  Description of Artificial Sequence: Synthetic oligonucleotide
uggaagaaguccucacuguc

SEQ ID NO: 2607 - RNA, 20 nt, Artificial Sequence
  Description of Artificial Sequence: Synthetic oligonucleotide
cuggaagaaguccucacugu

SEQ ID NO: 2608 - RNA, 20 nt, Artificial Sequence
  Description of Artificial Sequence: Synthetic oligonucleotide
agcuggaagaaguccucacu

SEQ ID NO: 2609 - RNA, 20 nt, Artificial Sequence
  Description of Artificial Sequence: Synthetic oligonucleotide
acugcaacaccaucaggcac

SEQ ID NO: 2610 - RNA, 20 nt, Artificial Sequence
  Description of Artificial Sequence: Synthetic oligonucleotide
gacugcaacaccaucaggca

SEQ ID NO: 2611 - RNA, 20 nt, Artificial Sequence
  Description of Artificial Sequence: Synthetic oligonucleotide
agacugcaacaccaucaggc

SEQ ID NO: 2612 - RNA, 20 nt, Artificial Sequence
  Description of Artificial Sequence: Synthetic oligonucleotide
cagacugcaacaccaucagg

SEQ ID NO: 2613 - RNA, 20 nt, Artificial Sequence
  Description of Artificial Sequence: Synthetic oligonucleotide
ccagacugcaacaccaucag

SEQ ID NO: 2614 - RNA, 20 nt, Artificial Sequence
  Description of Artificial Sequence: Synthetic oligonucleotide
gaccagacugcaacaccauc

SEQ ID NO: 2615 - RNA, 20 nt, Artificial Sequence
  Description of Artificial Sequence: Synthetic oligonucleotide
cucugaccagacugcaacac

SEQ ID NO: 2616 - RNA, 20 nt, Artificial Sequence
  Description of Artificial Sequence: Synthetic oligonucleotide
agcucugaccagacugcaac

SEQ ID NO: 2617 - RNA, 20 nt, Artificial Sequence
  Description of Artificial Sequence: Synthetic oligonucleotide
ccagcucugaccagacugca

SEQ ID NO: 2618 - RNA, 20 nt, Artificial Sequence
  Description of Artificial Sequence: Synthetic oligonucleotide
uguagggcuccagcucugac

SEQ ID NO: 2619 - RNA, 20 nt, Artificial Sequence
  Description of Artificial Sequence: Synthetic oligonucleotide
cuuguagggcuccagcucug

SEQ ID NO: 2620 - RNA, 20 nt, Artificial Sequence
  Description of Artificial Sequence: Synthetic oligonucleotide
ccuuguagggcuccagcucu

SEQ ID NO: 2621 - RNA, 20 nt, Artificial Sequence
  Description of Artificial Sequence: Synthetic oligonucleotide
acaggcauuggaagcagccc

SEQ ID NO: 2622 - RNA, 20 nt, Artificial Sequence
  Description of Artificial Sequence: Synthetic oligonucleotide
gacaggcauuggaagcagcc

SEQ ID NO: 2623 - RNA, 20 nt, Artificial Sequence
  Description of Artificial Sequence: Synthetic oligonucleotide
aaggacaggcauuggaagca

SEQ ID NO: 2624 - RNA, 20 nt, Artificial Sequence
  Description of Artificial Sequence: Synthetic oligonucleotide
aaaggacaggcauuggaagc

SEQ ID NO: 2625 - RNA, 20 nt, Artificial Sequence
  Description of Artificial Sequence: Synthetic oligonucleotide
uaaaggacaggcauuggaag

SEQ ID NO: 2626 - RNA, 20 nt, Artificial Sequence
  Description of Artificial Sequence: Synthetic oligonucleotide
cuaaaggacaggcauuggaa

SEQ ID NO: 2627 - RNA, 20 nt, Artificial Sequence
  Description of Artificial Sequence: Synthetic oligonucleotide
gcucuaaaggacaggcauug

SEQ ID NO: 2628 - RNA, 20 nt, Artificial Sequence
  Description of Artificial Sequence: Synthetic oligonucleotide
agcucuaaaggacaggcauu

SEQ ID NO: 2629 - RNA, 20 nt, Artificial Sequence
  Description of Artificial Sequence: Synthetic oligonucleotide
aagcucuaaaggacaggcau

SEQ ID NO: 2630 - RNA, 20 nt, Artificial Sequence
  Description of Artificial Sequence: Synthetic oligonucleotide
aaagcucuaaaggacaggca

SEQ ID NO: 2631 - RNA, 20 nt, Artificial Sequence
  Description of Artificial Sequence: Synthetic oligonucleotide
gaaagcucuaaaggacaggc

SEQ ID NO: 2632 - RNA, 20 nt, Artificial Sequence
  Description of Artificial Sequence: Synthetic oligonucleotide
cgggaaagcucuaaaggaca

SEQ ID NO: 2633 - RNA, 20 nt, Artificial Sequence
  Description of Artificial Sequence: Synthetic oligonucleotide
ccgggaaagcucuaaaggac

SEQ ID NO: 2634 - RNA, 20 nt, Artificial Sequence
  Description of Artificial Sequence: Synthetic oligonucleotide
aggguuaagcuagagaggaa

SEQ ID NO: 2635 - RNA, 20 nt, Artificial Sequence
  Description of Artificial Sequence: Synthetic oligonucleotide
ucaggguuaagcuagagagg

SEQ ID NO: 2636 - RNA, 20 nt, Artificial Sequence
  Description of Artificial Sequence: Synthetic oligonucleotide
gaucaggguuaagcuagaga

SEQ ID NO: 2637 - RNA, 20 nt, Artificial Sequence
  Description of Artificial Sequence: Synthetic oligonucleotide
ggaucaggguuaagcuagag

SEQ ID NO: 2638 - RNA, 20 nt, Artificial Sequence
  Description of Artificial Sequence: Synthetic oligonucleotide
aggaucaggguuaagcuaga

SEQ ID NO: 2639 - RNA, 20 nt, Artificial Sequence
  Description of Artificial Sequence: Synthetic oligonucleotide
cccaggaucaggguuaagcu

SEQ ID NO: 2640 - RNA, 20 nt, Artificial Sequence
  Description of Artificial Sequence: Synthetic oligonucleotide
caacuccuccugcaccuggu

SEQ ID NO: 2641 - RNA, 20 nt, Artificial Sequence
  Description of Artificial Sequence: Synthetic oligonucleotide
acaacuccuccugcaccugg

SEQ ID NO: 2642 - RNA, 20 nt, Artificial Sequence
  Description of Artificial Sequence: Synthetic oligonucleotide
gacaauuccacaacuccucc

SEQ ID NO: 2643 - RNA, 20 nt, Artificial Sequence
  Description of Artificial Sequence: Synthetic oligonucleotide
ugacaauuccacaacuccuc

SEQ ID NO: 2644 - RNA, 20 nt, Artificial Sequence
  Description of Artificial Sequence: Synthetic oligonucleotide
uugacaauuccacaacuccu

SEQ ID NO: 2645 - RNA, 20 nt, Artificial Sequence
  Description of Artificial Sequence: Synthetic oligonucleotide
cuugacaauuccacaacucc

SEQ ID NO: 2646 - RNA, 20 nt, Artificial Sequence
  Description of Artificial Sequence: Synthetic oligonucleotide
uccuugacaauuccacaacu

SEQ ID NO: 2647 - RNA, 20 nt, Artificial Sequence
  Description of Artificial Sequence: Synthetic oligonucleotide
auccuugacaauuccacaac

SEQ ID NO: 2648 - RNA, 20 nt, Artificial Sequence
  Description of Artificial Sequence: Synthetic oligonucleotide
cauccuugacaauuccacaa

SEQ ID NO: 2649 - RNA, 20 nt, Artificial Sequence
  Description of Artificial Sequence: Synthetic oligonucleotide
acauccuugacaauuccaca

SEQ ID NO: 2650 - RNA, 20 nt, Artificial Sequence
  Description of Artificial Sequence: Synthetic oligonucleotide
gacauccuugacaauuccac

SEQ ID NO: 2651 - RNA, 20 nt, Artificial Sequence
  Description of Artificial Sequence: Synthetic oligonucleotide
ugacauccuugacaauucca

SEQ ID NO: 2652 - RNA, 20 nt, Artificial Sequence
  Description of Artificial Sequence: Synthetic oligonucleotide
ugugugacauccuugacaau

SEQ ID NO: 2653 - RNA, 20 nt, Artificial Sequence
  Description of Artificial Sequence: Synthetic oligonucleotide
acugugugacauccuugaca

SEQ ID NO: 2654 - RNA, 20 nt, Artificial Sequence
  Description of Artificial Sequence: Synthetic oligonucleotide
acuuucuguccacuguguga

SEQ ID NO: 2655 - RNA, 20 nt, Artificial Sequence
  Description of Artificial Sequence: Synthetic oligonucleotide
ccucgcuuggacuuucuguc

SEQ ID NO: 2656 - RNA, 20 nt, Artificial Sequence
  Description of Artificial Sequence: Synthetic oligonucleotide
cccucgcuuggacuuucugu

SEQ ID NO: 2657 - RNA, 20 nt, Artificial Sequence
  Description of Artificial Sequence: Synthetic oligonucleotide
ucccucgcuuggacuuucug

SEQ ID NO: 2658 - RNA, 20 nt, Artificial Sequence
  Description of Artificial Sequence: Synthetic oligonucleotide
cucccucgcuuggacuuucu

SEQ ID NO: 2659 - RNA, 20 nt, Artificial Sequence
  Description of Artificial Sequence: Synthetic oligonucleotide
ccucccucgcuuggacuuuc

SEQ ID NO: 2660 - RNA, 20 nt, Artificial Sequence
  Description of Artificial Sequence: Synthetic oligonucleotide
cccucccucgcuuggacuuu

SEQ ID NO: 2661 - RNA, 20 nt, Artificial Sequence
  Description of Artificial Sequence: Synthetic oligonucleotide
uccaucagcacugggucaga

SEQ ID NO: 2662 - RNA, 20 nt, Artificial Sequence
  Description of Artificial Sequence: Synthetic oligonucleotide
accacuaaucuccaucagca

SEQ ID NO: 2663 - RNA, 20 nt, Artificial Sequence
  Description of Artificial Sequence: Synthetic oligonucleotide
caccacuaaucuccaucagc

SEQ ID NO: 2664 - RNA, 20 nt, Artificial Sequence
  Description of Artificial Sequence: Synthetic oligonucleotide
ccaccacuaaucuccaucag

SEQ ID NO: 2665 - RNA, 20 nt, Artificial Sequence
  Description of Artificial Sequence: Synthetic oligonucleotide
cccaccacuaaucuccauca

SEQ ID NO: 2666 - RNA, 20 nt, Artificial Sequence
  Description of Artificial Sequence: Synthetic oligonucleotide
accagacacccaccacuaau

SEQ ID NO: 2667 - RNA, 20 nt, Artificial Sequence
  Description of Artificial Sequence: Synthetic oligonucleotide
uaccagacacccaccacuaa

SEQ ID NO: 2668 - RNA, 20 nt, Artificial Sequence
  Description of Artificial Sequence: Synthetic oligonucleotide
cucauaccagacacccacca

SEQ ID NO: 2669 - RNA, 20 nt, Artificial Sequence
  Description of Artificial Sequence: Synthetic oligonucleotide
ccucauaccagacacccacc

SEQ ID NO: 2670 - RNA, 20 nt, Artificial Sequence
  Description of Artificial Sequence: Synthetic oligonucleotide
uccucauaccagacacccac

SEQ ID NO: 2671 - RNA, 20 nt, Artificial Sequence
  Description of Artificial Sequence: Synthetic oligonucleotide
auccucauaccagacaccca

SEQ ID NO: 2672 - RNA, 20 nt, Artificial Sequence
  Description of Artificial Sequence: Synthetic oligonucleotide
gauccucauaccagacaccc

SEQ ID NO: 2673 - RNA, 20 nt, Artificial Sequence
  Description of Artificial Sequence: Synthetic oligonucleotide
agauccucauaccagacacc

SEQ ID NO: 2674 - RNA, 20 nt, Artificial Sequence
  Description of Artificial Sequence: Synthetic oligonucleotide
uagauccucauaccagacac

SEQ ID NO: 2675 - RNA, 20 nt, Artificial Sequence
  Description of Artificial Sequence: Synthetic oligonucleotide
guagauccucauaccagaca

SEQ ID NO: 2676 - RNA, 20 nt, Artificial Sequence
  Description of Artificial Sequence: Synthetic oligonucleotide
aguagauccucauaccagac

SEQ ID NO: 2677 - RNA, 20 nt, Artificial Sequence
  Description of Artificial Sequence: Synthetic oligonucleotide
caguagauccucauaccaga

SEQ ID NO: 2678 - RNA, 20 nt, Artificial Sequence
  Description of Artificial Sequence: Synthetic oligonucleotide
ugcaguagauccucauacca

SEQ ID NO: 2679 - RNA, 20 nt, Artificial Sequence
  Description of Artificial Sequence: Synthetic oligonucleotide
gugcaguagauccucauacc

SEQ ID NO: 2680 - RNA, 20 nt, Artificial Sequence
  Description of Artificial Sequence: Synthetic oligonucleotide
agugcaguagauccucauac

SEQ ID NO: 2681 - RNA, 20 nt, Artificial Sequence
  Description of Artificial Sequence: Synthetic oligonucleotide
acucuguaggacacccuugu

SEQ ID NO: 2682 - RNA, 20 nt, Artificial Sequence
  Description of Artificial Sequence: Synthetic oligonucleotide
cacucuguaggacacccuug

SEQ ID NO: 2683 - RNA, 20 nt, Artificial Sequence
  Description of Artificial Sequence: Synthetic oligonucleotide
ccacucuguaggacacccuu

SEQ ID NO: 2684 - RNA, 20 nt, Artificial Sequence
  Description of Artificial Sequence: Synthetic oligonucleotide
uccacucuguaggacacccu

SEQ ID NO: 2685 - RNA, 20 nt, Artificial Sequence
  Description of Artificial Sequence: Synthetic oligonucleotide
cuccacucuguaggacaccc

SEQ ID NO: 2686 - RNA, 20 nt, Artificial Sequence
  Description of Artificial Sequence: Synthetic oligonucleotide
acuccacucuguaggacacc

SEQ ID NO: 2687 - RNA, 20 nt, Artificial Sequence
  Description of Artificial Sequence: Synthetic oligonucleotide
cacuccacucuguaggacac

SEQ ID NO: 2688 - RNA, 20 nt, Artificial Sequence
  Description of Artificial Sequence: Synthetic oligonucleotide
agcacuccacucuguaggac

SEQ ID NO: 2689 - RNA, 20 nt, Artificial Sequence
  Description of Artificial Sequence: Synthetic oligonucleotide
uaugacagcacuccacucug

SEQ ID NO: 2690 - RNA, 20 nt, Artificial Sequence
  Description of Artificial Sequence: Synthetic oligonucleotide
auaugacagcacuccacucu

SEQ ID NO: 2691 - RNA, 20 nt, Artificial Sequence
  Description of Artificial Sequence: Synthetic oligonucleotide
uugcugugcuugggccucuc

SEQ ID NO: 2692 - RNA, 20 nt, Artificial Sequence
  Description of Artificial Sequence: Synthetic oligonucleotide
acgucaaaggugaaucgggc

SEQ ID NO: 2693 - RNA, 20 nt, Artificial Sequence
  Description of Artificial Sequence: Synthetic oligonucleotide
cacgucaaaggugaaucggg

SEQ ID NO: 2694 - RNA, 20 nt, Artificial Sequence
  Description of Artificial Sequence: Synthetic oligonucleotide
acacgucaaaggugaaucgg

SEQ ID NO: 2695 - RNA, 20 nt, Artificial Sequence
  Description of Artificial Sequence: Synthetic oligonucleotide
uacacgucaaaggugaaucg

SEQ ID NO: 2696 - RNA, 20 nt, Artificial Sequence
  Description of Artificial Sequence: Synthetic oligonucleotide
guacacgucaaaggugaauc

SEQ ID NO: 2697 - RNA, 20 nt, Artificial Sequence
  Description of Artificial Sequence: Synthetic oligonucleotide
ggcugccaaagaggucucga

SEQ ID NO: 2698 - RNA, 20 nt, Artificial Sequence
  Description of Artificial Sequence: Synthetic oligonucleotide
ucaggcugccaaagaggucu

SEQ ID NO: 2699 - RNA, 20 nt, Artificial Sequence
  Description of Artificial Sequence: Synthetic oligonucleotide
cauucaggcugccaaagagg

SEQ ID NO: 2700 - RNA, 20 nt, Artificial Sequence
  Description of Artificial Sequence: Synthetic oligonucleotide
gacauucaggcugccaaaga

SEQ ID NO: 2701 - RNA, 20 nt, Artificial Sequence
  Description of Artificial Sequence: Synthetic oligonucleotide
ugacauucaggcugccaaag

SEQ ID NO: 2702 - RNA, 20 nt, Artificial Sequence
  Description of Artificial Sequence: Synthetic oligonucleotide
cuuugacauucaggcugcca

SEQ ID NO: 2703 - RNA, 20 nt, Artificial Sequence
  Description of Artificial Sequence: Synthetic oligonucleotide
gcuuugacauucaggcugcc

SEQ ID NO: 2704 - RNA, 20 nt, Artificial Sequence
  Description of Artificial Sequence: Synthetic oligonucleotide
ccguagaauguggcuuugac

SEQ ID NO: 2705 - RNA, 20 nt, Artificial Sequence
  Description of Artificial Sequence: Synthetic oligonucleotide
gcccguagaauguggcuuug

SEQ ID NO: 2706 - RNA, 20 nt, Artificial Sequence
  Description of Artificial Sequence: Synthetic oligonucleotide
uagagcccguagaauguggc

SEQ ID NO: 2707 - RNA, 20 nt, Artificial Sequence
  Description of Artificial Sequence: Synthetic oligonucleotide
guagagcccguagaaugugg

SEQ ID NO: 2708 - RNA, 20 nt, Artificial Sequence
  Description of Artificial Sequence: Synthetic oligonucleotide
aguagagcccguagaaugug

SEQ ID NO: 2709 - RNA, 20 nt, Artificial Sequence
  Description of Artificial Sequence: Synthetic oligonucleotide
agaguagagcccguagaaug

SEQ ID NO: 2710 - RNA, 20 nt, Artificial Sequence
  Description of Artificial Sequence: Synthetic oligonucleotide
uagaguagagcccguagaau

SEQ ID NO: 2711 - RNA, 20 nt, Artificial Sequence
  Description of Artificial Sequence: Synthetic oligonucleotide
auagaguagagcccguagaa

SEQ ID NO: 2712 - RNA, 20 nt, Artificial Sequence
  Description of Artificial Sequence: Synthetic oligonucleotide
cauagaguagagcccguaga

SEQ ID NO: 2713 - RNA, 20 nt, Artificial Sequence
  Description of Artificial Sequence: Synthetic oligonucleotide
ucauagaguagagcccguag

SEQ ID NO: 2714 - RNA, 20 nt, Artificial Sequence
  Description of Artificial Sequence: Synthetic oligonucleotide
cucauagaguagagcccgua

SEQ ID NO: 2715 - RNA, 20 nt, Artificial Sequence
  Description of Artificial Sequence: Synthetic oligonucleotide
gaaagucacaacucauagag

SEQ ID NO: 2716 - RNA, 20 nt, Artificial Sequence
  Description of Artificial Sequence: Synthetic oligonucleotide
ccuugaaagucacaacucau

SEQ ID NO: 2717 - RNA, 20 nt, Artificial Sequence
  Description of Artificial Sequence: Synthetic oligonucleotide
aaguccuugaaagucacaac

SEQ ID NO: 2718 - RNA, 20 nt, Artificial Sequence
  Description of Artificial Sequence: Synthetic oligonucleotide
ccaaguccuugaaagucaca

SEQ ID NO: 2719 - RNA, 20 nt, Artificial Sequence
  Description of Artificial Sequence: Synthetic oligonucleotide
uucuuugggccaaguccuug

SEQ ID NO: 2720 - RNA, 20 nt, Artificial Sequence
  Description of Artificial Sequence: Synthetic oligonucleotide
uuucuuugggccaaguccuu

SEQ ID NO: 2721 - RNA, 20 nt, Artificial Sequence
  Description of Artificial Sequence: Synthetic oligonucleotide
uugauuucugaccugaguac

SEQ ID NO: 2722 - RNA, 20 nt, Artificial Sequence
  Description of Artificial Sequence: Synthetic oligonucleotide
guugauuucugaccugagua

SEQ ID NO: 2723 - RNA, 20 nt, Artificial Sequence
  Description of Artificial Sequence: Synthetic oligonucleotide
gggacuauccaacuguaggg

SEQ ID NO: 2724 - RNA, 20 nt, Artificial Sequence
  Description of Artificial Sequence: Synthetic oligonucleotide
gcaagaggacgaauuauggg

SEQ ID NO: 2725 - RNA, 20 nt, Artificial Sequence
  Description of Artificial Sequence: Synthetic oligonucleotide
ugcaagaggacgaauuaugg

SEQ ID NO: 2726 - RNA, 20 nt, Artificial Sequence
  Description of Artificial Sequence: Synthetic oligonucleotide
gugcaagaggacgaauuaug

SEQ ID NO: 2727 - RNA, 20 nt, Artificial Sequence
  Description of Artificial Sequence: Synthetic oligonucleotide
ggugcaagaggacgaauuau

SEQ ID NO: 2728 - RNA, 20 nt, Artificial Sequence
  Description of Artificial Sequence: Synthetic oligonucleotide
gggugcaagaggacgaauua

SEQ ID NO: 2729 - RNA, 20 nt, Artificial Sequence
  Description of Artificial Sequence: Synthetic oligonucleotide
ugggugcaagaggacgaauu

SEQ ID NO: 2730 - RNA, 20 nt, Artificial Sequence
  Description of Artificial Sequence: Synthetic oligonucleotide
gugggugcaagaggacgaau

SEQ ID NO: 2731 - RNA, 20 nt, Artificial Sequence
  Description of Artificial Sequence: Synthetic oligonucleotide
ggugggugcaagaggacgaa

SEQ ID NO: 2732 - RNA, 20 nt, Artificial Sequence
  Description of Artificial Sequence: Synthetic oligonucleotide
uaggugggugcaagaggacg

SEQ ID NO: 2733 - RNA, 20 nt, Artificial Sequence
  Description of Artificial Sequence: Synthetic oligonucleotide
guaggugggugcaagaggac

SEQ ID NO: 2734 - RNA, 20 nt, Artificial Sequence
  Description of Artificial Sequence: Synthetic oligonucleotide
gguaggugggugcaagagga

SEQ ID NO: 2735 - RNA, 20 nt, Artificial Sequence
  Description of Artificial Sequence: Synthetic oligonucleotide
ccacaagcaagagcuaacua

SEQ ID NO: 2736 - RNA, 20 nt, Artificial Sequence
  Description of Artificial Sequence: Synthetic oligonucleotide
acuuuccacaagcaagagcu

SEQ ID NO: 2737 - RNA, 20 nt, Artificial Sequence
  Description of Artificial Sequence: Synthetic oligonucleotide
gacuuuccacaagcaagagc

SEQ ID NO: 2738 - RNA, 20 nt, Artificial Sequence
  Description of Artificial Sequence: Synthetic oligonucleotide
ggacuuuccacaagcaagag

SEQ ID NO: 2739 - RNA, 20 nt, Artificial Sequence
  Description of Artificial Sequence: Synthetic oligonucleotide
aggacuuuccacaagcaaga

SEQ ID NO: 2740 - RNA, 20 nt, Artificial Sequence
  Description of Artificial Sequence: Synthetic oligonucleotide
gaggacuuuccacaagcaag

SEQ ID NO: 2741 - RNA, 20 nt, Artificial Sequence
  Description of Artificial Sequence: Synthetic oligonucleotide
ugaggacuuuccacaagcaa

SEQ ID NO: 2742 - RNA, 20 nt, Artificial Sequence
  Description of Artificial Sequence: Synthetic oligonucleotide
augaggacuuuccacaagca

SEQ ID NO: 2743 - RNA, 20 nt, Artificial Sequence
  Description of Artificial Sequence: Synthetic oligonucleotide
gaugaggacuuuccacaagc

SEQ ID NO: 2744 - RNA, 20 nt, Artificial Sequence
  Description of Artificial Sequence: Synthetic oligonucleotide
agaugaggacuuuccacaag

SEQ ID NO: 2745 - RNA, 20 nt, Artificial Sequence
  Description of Artificial Sequence: Synthetic oligonucleotide
gagaugaggacuuuccacaa

SEQ ID NO: 2746 - RNA, 20 nt, Artificial Sequence
  Description of Artificial Sequence: Synthetic oligonucleotide
ggagaugaggacuuuccaca

SEQ ID NO: 2747 - RNA, 20 nt, Artificial Sequence
  Description of Artificial Sequence: Synthetic oligonucleotide
ugggagaugaggacuuucca

SEQ ID NO: 2748 - RNA, 20 nt, Artificial Sequence
  Description of Artificial Sequence: Synthetic oligonucleotide
gcugggagaugaggacuuuc

SEQ ID NO: 2749 - RNA, 20 nt, Artificial Sequence
  Description of Artificial Sequence: Synthetic oligonucleotide
ucaagcugggagaugaggac

SEQ ID NO: 2750 - RNA, 20 nt, Artificial Sequence
  Description of Artificial Sequence: Synthetic oligonucleotide
aagccaucaagcugggagau

SEQ ID NO: 2751 - RNA, 20 nt, Artificial Sequence
  Description of Artificial Sequence: Synthetic oligonucleotide
gaagccaucaagcugggaga

SEQ ID NO: 2752 - RNA, 20 nt, Artificial Sequence
  Description of Artificial Sequence: Synthetic oligonucleotide
ggaggaagccaucaagcugg

SEQ ID NO: 2753 - RNA, 20 nt, Artificial Sequence
  Description of Artificial Sequence: Synthetic oligonucleotide
gggaggaagccaucaagcug

SEQ ID NO: 2754 - RNA, 20 nt, Artificial Sequence
  Description of Artificial Sequence: Synthetic oligonucleotide
aacuugggaggaagccauca

SEQ ID NO: 2755 - RNA, 20 nt, Artificial Sequence
  Description of Artificial Sequence: Synthetic oligonucleotide
aaacuugggaggaagccauc

SEQ ID NO: 2756 - RNA, 20 nt, Artificial Sequence
  Description of Artificial Sequence: Synthetic oligonucleotide
cagcaguguggagguccaac

SEQ ID NO: 2757 - RNA, 20 nt, Artificial Sequence
  Description of Artificial Sequence: Synthetic oligonucleotide
gcagcaguguggagguccaa

SEQ ID NO: 2758 - RNA, 20 nt, Artificial Sequence
  Description of Artificial Sequence: Synthetic oligonucleotide
ugcagcaguguggaggucca

SEQ ID NO: 2759 - RNA, 20 nt, Artificial Sequence
  Description of Artificial Sequence: Synthetic oligonucleotide
uugcagcaguguggaggucc

SEQ ID NO: 2760 - RNA, 20 nt, Artificial Sequence
  Description of Artificial Sequence: Synthetic oligonucleotide
gguggaggaaauucccagca

SEQ ID NO: 2761 - RNA, 20 nt, Artificial Sequence
  Description of Artificial Sequence: Synthetic oligonucleotide
acgaaggguggaggaaauuc

SEQ ID NO: 2762 - RNA, 20 nt, Artificial Sequence
  Description of Artificial Sequence: Synthetic oligonucleotide
gacgaaggguggaggaaauu

SEQ ID NO: 2763 - RNA, 20 nt, Artificial Sequence
  Description of Artificial Sequence: Synthetic oligonucleotide
augacgaaggguggaggaaa

SEQ ID NO: 2764 - RNA, 20 nt, Artificial Sequence
  Description of Artificial Sequence: Synthetic oligonucleotide
caugacgaaggguggaggaa

SEQ ID NO: 2765 - RNA, 20 nt, Artificial Sequence
  Description of Artificial Sequence: Synthetic oligonucleotide
gcaugacgaaggguggagga

SEQ ID NO: 2766 - RNA, 20 nt, Artificial Sequence
  Description of Artificial Sequence: Synthetic oligonucleotide
ugcaugacgaaggguggagg

SEQ ID NO: 2767 - RNA, 20 nt, Artificial Sequence
  Description of Artificial Sequence: Synthetic oligonucleotide
cugcaugacgaaggguggag

SEQ ID NO: 2768 - RNA, 20 nt, Artificial Sequence
  Description of Artificial Sequence: Synthetic oligonucleotide
acugcaugacgaagggugga

SEQ ID NO: 2769 - RNA, 20 nt, Artificial Sequence
  Description of Artificial Sequence: Synthetic oligonucleotide
cacugcaugacgaagggugg

SEQ ID NO: 2770 - RNA, 20 nt, Artificial Sequence
  Description of Artificial Sequence: Synthetic oligonucleotide
ccacugcaugacgaagggug

SEQ ID NO: 2771 - RNA, 20 nt, Artificial Sequence
  Description of Artificial Sequence: Synthetic oligonucleotide
uccacugcaugacgaagggu

SEQ ID NO: 2772 - RNA, 20 nt, Artificial Sequence
  Description of Artificial Sequence: Synthetic oligonucleotide
cuccacugcaugacgaaggg

SEQ ID NO: 2773 - RNA, 20 nt, Artificial Sequence
  Description of Artificial Sequence: Synthetic oligonucleotide
ccuccacugcaugacgaagg

SEQ ID NO: 2774 - RNA, 20 nt, Artificial Sequence
  Description of Artificial Sequence: Synthetic oligonucleotide
cccuccacugcaugacgaag

SEQ ID NO: 2775 - RNA, 20 nt, Artificial Sequence
  Description of Artificial Sequence: Synthetic oligonucleotide
cuuaguaggaauggaggcgg

SEQ ID NO: 2776 - RNA, 20 nt, Artificial Sequence
  Description of Artificial Sequence: Synthetic oligonucleotide
ccuuaguaggaauggaggcg

SEQ ID NO: 2777 - RNA, 20 nt, Artificial Sequence
  Description of Artificial Sequence: Synthetic oligonucleotide
cccuuaguaggaauggaggc

SEQ ID NO: 2778 - RNA, 20 nt, Artificial Sequence
  Description of Artificial Sequence: Synthetic oligonucleotide
ucgguuggaaugauucuggg

SEQ ID NO: 2779 - RNA, 20 nt, Artificial Sequence
  Description of Artificial Sequence: Synthetic oligonucleotide
gucgguuggaaugauucugg

SEQ ID NO: 2780 - RNA, 20 nt, Artificial Sequence
  Description of Artificial Sequence: Synthetic oligonucleotide
ggucgguuggaaugauucug

SEQ ID NO: 2781 - RNA, 20 nt, Artificial Sequence
  Description of Artificial Sequence: Synthetic oligonucleotide
gggucgguuggaaugauucu

SEQ ID NO: 2782 - RNA, 20 nt, Artificial Sequence
  Description of Artificial Sequence: Synthetic oligonucleotide
ugggucgguuggaaugauuc

SEQ ID NO: 2783 - RNA, 20 nt, Artificial Sequence
  Description of Artificial Sequence: Synthetic oligonucleotide
gugggucgguuggaaugauu

SEQ ID NO: 2784 - RNA, 20 nt, Artificial Sequence
  Description of Artificial Sequence: Synthetic oligonucleotide
agugggucgguuggaaugau

SEQ ID NO: 2785 - RNA, 20 nt, Artificial Sequence
  Description of Artificial Sequence: Synthetic oligonucleotide
cagugggucgguuggaauga

SEQ ID NO: 2786 - RNA, 20 nt, Artificial Sequence
  Description of Artificial Sequence: Synthetic oligonucleotide
gcagugggucgguuggaaug

SEQ ID NO: 2787 - RNA, 20 nt, Artificial Sequence
  Description of Artificial Sequence: Synthetic oligonucleotide
ugcagugggucgguuggaau

SEQ ID NO: 2788 - RNA, 20 nt, Artificial Sequence
  Description of Artificial Sequence: Synthetic oligonucleotide
uugcagugggucgguuggaa

SEQ ID NO: 2789 - RNA, 20 nt, Artificial Sequence
  Description of Artificial Sequence: Synthetic oligonucleotide
uuugcagugggucgguugga

SEQ ID NO: 2790 - RNA, 20 nt, Artificial Sequence
  Description of Artificial Sequence: Synthetic oligonucleotide
cuuugcagugggucgguugg

SEQ ID NO: 2791 - RNA, 20 nt, Artificial Sequence
  Description of Artificial Sequence: Synthetic oligonucleotide
ucuuugcagugggucgguug

SEQ ID NO: 2792 - RNA, 20 nt, Artificial Sequence
  Description of Artificial Sequence: Synthetic oligonucleotide
uagucuuugcagugggucgg

SEQ ID NO: 2793 - RNA, 20 nt, Artificial Sequence
  Description of Artificial Sequence: Synthetic oligonucleotide
auagucuuugcagugggucg

SEQ ID NO: 2794 - RNA, 20 nt, Artificial Sequence
  Description of Artificial Sequence: Synthetic oligonucleotide
cugucauagucuuugcagug

SEQ ID NO: 2795 - RNA, 20 nt, Artificial Sequence
  Description of Artificial Sequence: Synthetic oligonucleotide
ugcugucauagucuuugcag

SEQ ID NO: 2796 - RNA, 20 nt, Artificial Sequence
  Description of Artificial Sequence: Synthetic oligonucleotide
ucuagccuguacugucugca

SEQ ID NO: 2797 - RNA, 20 nt, Artificial Sequence
  Description of Artificial Sequence: Synthetic oligonucleotide
aucuagccuguacugucugc

SEQ ID NO: 2798 - RNA, 20 nt, Artificial Sequence
  Description of Artificial Sequence: Synthetic oligonucleotide
uaucuagccuguacugucug

SEQ ID NO: 2799 - RNA, 20 nt, Artificial Sequence
  Description of Artificial Sequence: Synthetic oligonucleotide
uuaucuagccuguacugucu

SEQ ID NO: 2800 - RNA, 20 nt, Artificial Sequence
  Description of Artificial Sequence: Synthetic oligonucleotide
guuaucuagccuguacuguc

SEQ ID NO: 2801 - RNA, 20 nt, Artificial Sequence
  Description of Artificial Sequence: Synthetic oligonucleotide
gguuaucuagccuguacugu

SEQ ID NO: 2802 - RNA, 20 nt, Artificial Sequence
  Description of Artificial Sequence: Synthetic oligonucleotide
ggguuaucuagccuguacug

SEQ ID NO: 2803 - RNA, 20 nt, Artificial Sequence
  Description of Artificial Sequence: Synthetic oligonucleotide
uggguuaucuagccuguacu

SEQ ID NO: 2804 - RNA, 20 nt, Artificial Sequence
  Description of Artificial Sequence: Synthetic oligonucleotide
guggguuaucuagccuguac

SEQ ID NO: 2805 - RNA, 20 nt, Artificial Sequence
  Description of Artificial Sequence: Synthetic oligonucleotide
gguggguuaucuagccugua

SEQ ID NO: 2806 - RNA, 20 nt, Artificial Sequence
  Description of Artificial Sequence: Synthetic oligonucleotide
ggguggguuaucuagccugu

SEQ ID NO: 2807 - RNA, 20 nt, Artificial Sequence
  Description of Artificial Sequence: Synthetic oligonucleotide
uggguggguuaucuagccug

SEQ ID NO: 2808 - RNA, 20 nt, Artificial Sequence
  Description of Artificial Sequence: Synthetic oligonucleotide
uuggguggguuaucuagccu

SEQ ID NO: 2809 - RNA, 20 nt, Artificial Sequence
  Description of Artificial Sequence: Synthetic oligonucleotide
auuggguggguuaucuagcc

SEQ ID NO: 2810 - RNA, 20 nt, Artificial Sequence
  Description of Artificial Sequence: Synthetic oligonucleotide
aauuggguggguuaucuagc

SEQ ID NO: 2811 - RNA, 20 nt, Artificial Sequence
  Description of Artificial Sequence: Synthetic oligonucleotide
aaauuggguggguuaucuag

SEQ ID NO: 2812 - RNA, 20 nt, Artificial Sequence
  Description of Artificial Sequence: Synthetic oligonucleotide
ggaaauuggguggguuaucu

SEQ ID NO: 2813 - RNA, 20 nt, Artificial Sequence
  Description of Artificial Sequence: Synthetic oligonucleotide
gggaaauuggguggguuauc

SEQ ID NO: 2814 - RNA, 20 nt, Artificial Sequence
  Description of Artificial Sequence: Synthetic oligonucleotide
gaaagguucugucacgaggg

SEQ ID NO: 2815 - RNA, 20 nt, Artificial Sequence
  Description of Artificial Sequence: Synthetic oligonucleotide
gcugaaagguucugucacga

SEQ ID NO: 2816 - RNA, 20 nt, Artificial Sequence
  Description of Artificial Sequence: Synthetic oligonucleotide
ugcugaaagguucugucacg

SEQ ID NO: 2817 - RNA, 20 nt, Artificial Sequence
  Description of Artificial Sequence: Synthetic oligonucleotide
ggcguuaugcugaaagguuc

SEQ ID NO: 2818 - RNA, 20 nt, Artificial Sequence
  Description of Artificial Sequence: Synthetic oligonucleotide
aggcguuaugcugaaagguu

SEQ ID NO: 2819 - RNA, 20 nt, Artificial Sequence
  Description of Artificial Sequence: Synthetic oligonucleotide
gaggcguuaugcugaaaggu

SEQ ID NO: 2820 - RNA, 20 nt, Artificial Sequence
  Description of Artificial Sequence: Synthetic oligonucleotide
ugaggcguuaugcugaaagg

SEQ ID NO: 2821 - RNA, 20 nt, Artificial Sequence
  Description of Artificial Sequence: Synthetic oligonucleotide
gugaggcguuaugcugaaag

SEQ ID NO: 2822 - RNA, 20 nt, Artificial Sequence
  Description of Artificial Sequence: Synthetic oligonucleotide
augugaggcguuaugcugaa

SEQ ID NO: 2823 - RNA, 20 nt, Artificial Sequence
  Description of Artificial Sequence: Synthetic oligonucleotide
gaugugaggcguuaugcuga

SEQ ID NO: 2824 - RNA, 20 nt, Artificial Sequence
  Description of Artificial Sequence: Synthetic oligonucleotide
ggaugugaggcguuaugcug

SEQ ID NO: 2825 - RNA, 20 nt, Artificial Sequence
  Description of Artificial Sequence: Synthetic oligonucleotide
gggaugugaggcguuaugcu

SEQ ID NO: 2826 - RNA, 20 nt, Artificial Sequence
  Description of Artificial Sequence: Synthetic oligonucleotide
cuugggaugugaggcguuau

SEQ ID NO: 2827 - RNA, 20 nt, Artificial Sequence
  Description of Artificial Sequence: Synthetic oligonucleotide
agacuugggaugugaggcgu

SEQ ID NO: 2828 - RNA, 20 nt, Artificial Sequence
  Description of Artificial Sequence: Synthetic oligonucleotide
uagacuugggaugugaggcg

SEQ ID NO: 2829 - RNA, 20 nt, Artificial Sequence
  Description of Artificial Sequence: Synthetic oligonucleotide
auagacuugggaugugaggc

SEQ ID NO: 2830 - RNA, 20 nt, Artificial Sequence
  Description of Artificial Sequence: Synthetic oligonucleotide
uauagacuugggaugugagg

SEQ ID NO: 2831 - RNA, 20 nt, Artificial Sequence
  Description of Artificial Sequence: Synthetic oligonucleotide
ggguauagacuugggaugug

SEQ ID NO: 2832 - RNA, 20 nt, Artificial Sequence
  Description of Artificial Sequence: Synthetic oligonucleotide
aggguauagacuugggaugu

SEQ ID NO: 2833 - RNA, 20 nt, Artificial Sequence
  Description of Artificial Sequence: Synthetic oligonucleotide
aagguggcuaggaaagaaca

SEQ ID NO: 2834 - RNA, 20 nt, Artificial Sequence
  Description of Artificial Sequence: Synthetic oligonucleotide
aaagguggcuaggaaagaac

SEQ ID NO: 2835 - RNA, 20 nt, Artificial Sequence
  Description of Artificial Sequence: Synthetic oligonucleotide
gaaagguggcuaggaaagaa

SEQ ID NO: 2836 - RNA, 20 nt, Artificial Sequence
  Description of Artificial Sequence: Synthetic oligonucleotide
acaucuugaucuuggccuuu

SEQ ID NO: 2837 - RNA, 20 nt, Artificial Sequence
  Description of Artificial Sequence: Synthetic oligonucleotide
ggcugggaucaagaugccug

SEQ ID NO: 2838 - RNA, 20 nt, Artificial Sequence
  Description of Artificial Sequence: Synthetic oligonucleotide
gucaggcugggaucaagaug

SEQ ID NO: 2839 - RNA, 20 nt, Artificial Sequence
  Description of Artificial Sequence: Synthetic oligonucleotide
agucaggcugggaucaagau

SEQ ID NO: 2840 - RNA, 20 nt, Artificial Sequence
  Description of Artificial Sequence: Synthetic oligonucleotide
cagucaggcugggaucaaga

SEQ ID NO: 2841 - RNA, 20 nt, Artificial Sequence
  Description of Artificial Sequence: Synthetic oligonucleotide
agcagucaggcugggaucaa

SEQ ID NO: 2842 - RNA, 20 nt, Artificial Sequence
  Description of Artificial Sequence: Synthetic oligonucleotide
gauguagcagcagucaggcu

SEQ ID NO: 2843 - RNA, 20 nt, Artificial Sequence
  Description of Artificial Sequence: Synthetic oligonucleotide
ggauuagauguagcagcagu

SEQ ID NO: 2844 - RNA, 20 nt, Artificial Sequence
  Description of Artificial Sequence: Synthetic oligonucleotide
gggauuagauguagcagcag

SEQ ID NO: 2845 - RNA, 20 nt, Artificial Sequence
  Description of Artificial Sequence: Synthetic oligonucleotide
gacaggaggcauugguaggg

SEQ ID NO: 2846 - RNA, 20 nt, Artificial Sequence
  Description of Artificial Sequence: Synthetic oligonucleotide
uuagggacaggaggcauugg

SEQ ID NO: 2847 - RNA, 20 nt, Artificial Sequence
  Description of Artificial Sequence: Synthetic oligonucleotide
uuuagggacaggaggcauug

SEQ ID NO: 2848 - RNA, 20 nt, Artificial Sequence
  Description of Artificial Sequence: Synthetic oligonucleotide
gaguuuagggacaggaggca

SEQ ID NO: 2849 - RNA, 20 nt, Artificial Sequence
  Description of Artificial Sequence: Synthetic oligonucleotide
ggaguuuagggacaggaggc

SEQ ID NO: 2850 - RNA, 20 nt, Artificial Sequence
  Description of Artificial Sequence: Synthetic oligonucleotide
gcugucaucaguaugcuggg

SEQ ID NO: 2851 - RNA, 20 nt, Artificial Sequence
  Description of Artificial Sequence: Synthetic oligonucleotide
ggcugucaucaguaugcugg

SEQ ID NO: 2852 - RNA, 20 nt, Artificial Sequence
  Description of Artificial Sequence: Synthetic oligonucleotide
gggcugucaucaguaugcug

SEQ ID NO: 2853 - RNA, 20 nt, Artificial Sequence
  Description of Artificial Sequence: Synthetic oligonucleotide
agggcugucaucaguaugcu

SEQ ID NO: 2854 - RNA, 20 nt, Artificial Sequence
  Description of Artificial Sequence: Synthetic oligonucleotide
agagagggcugucaucagua

SEQ ID NO: 2855 - RNA, 20 nt, Artificial Sequence
  Description of Artificial Sequence: Synthetic oligonucleotide
cagagagggcugucaucagu

SEQ ID NO: 2856 - RNA, 20 nt, Artificial Sequence
  Description of Artificial Sequence: Synthetic oligonucleotide
ucagagagggcugucaucag

SEQ ID NO: 2857 - RNA, 20 nt, Artificial Sequence
  Description of Artificial Sequence: Synthetic oligonucleotide
gucagagagggcugucauca

SEQ ID NO: 2858 - RNA, 20 nt, Artificial Sequence
  Description of Artificial Sequence: Synthetic oligonucleotide
gguaaagucagagagggcug

SEQ ID NO: 2859 - RNA, 20 nt, Artificial Sequence
  Description of Artificial Sequence: Synthetic oligonucleotide
gggaaggguaugaagacaga

SEQ ID NO: 2860 - RNA, 20 nt, Artificial Sequence
  Description of Artificial Sequence: Synthetic oligonucleotide
gucagaagucuuagugguaa

SEQ ID NO: 2861 - RNA, 20 nt, Artificial Sequence
  Description of Artificial Sequence: Synthetic oligonucleotide
agucagaagucuuaguggua

SEQ ID NO: 2862 - RNA, 20 nt, Artificial Sequence
  Description of Artificial Sequence: Synthetic oligonucleotide
gagucagaagucuuaguggu

SEQ ID NO: 2863 - RNA, 20 nt, Artificial Sequence
  Description of Artificial Sequence: Synthetic oligonucleotide
cugggacuggguguugaugg

SEQ ID NO: 2864 - RNA, 20 nt, Artificial Sequence
  Description of Artificial Sequence: Synthetic oligonucleotide
aucugggacuggguguugau

SEQ ID NO: 2865 - RNA, 20 nt, Artificial Sequence
  Description of Artificial Sequence: Synthetic oligonucleotide
gaucugggacuggguguuga

SEQ ID NO: 2866 - RNA, 20 nt, Artificial Sequence
  Description of Artificial Sequence: Synthetic oligonucleotide
uggaucugggacuggguguu

SEQ ID NO: 2867 - RNA, 20 nt, Artificial Sequence
  Description of Artificial Sequence: Synthetic oligonucleotide
uuuggaucugggacugggug

SEQ ID NO: 2868 - RNA, 20 nt, Artificial Sequence
  Description of Artificial Sequence: Synthetic oligonucleotide
gcuuuggaucugggacuggg

SEQ ID NO: 2869 - RNA, 20 nt, Artificial Sequence
  Description of Artificial Sequence: Synthetic oligonucleotide
acacugcugagcuggaagac

SEQ ID NO: 2870 - RNA, 20 nt, Artificial Sequence
  Description of Artificial Sequence: Synthetic oligonucleotide
cgagacacugcugagcugga

SEQ ID NO: 2871 - RNA, 20 nt, Artificial Sequence
  Description of Artificial Sequence: Synthetic oligonucleotide
acgagacacugcugagcugg

SEQ ID NO: 2872 - RNA, 20 nt, Artificial Sequence
  Description of Artificial Sequence: Synthetic oligonucleotide
aacgagacacugcugagcug

SEQ ID NO: 2873 - RNA, 20 nt, Artificial Sequence
  Description of Artificial Sequence: Synthetic oligonucleotide
gaacgagacacugcugagcu

SEQ ID NO: 2874 - RNA, 20 nt, Artificial Sequence
  Description of Artificial Sequence: Synthetic oligonucleotide
ggaacgagacacugcugagc

SEQ ID NO: 2875 - RNA, 20 nt, Artificial Sequence
  Description of Artificial Sequence: Synthetic oligonucleotide
gggaacgagacacugcugag

SEQ ID NO: 2876 - RNA, 20 nt, Artificial Sequence
  Description of Artificial Sequence: Synthetic oligonucleotide
agggaacgagacacugcuga

SEQ ID NO: 2877 - RNA, 20 nt, Artificial Sequence
  Description of Artificial Sequence: Synthetic oligonucleotide
cagggaacgagacacugcug

SEQ ID NO: 2878 - RNA, 20 nt, Artificial Sequence
  Description of Artificial Sequence: Synthetic oligonucleotide
ccagggaacgagacacugcu

SEQ ID NO: 2879 - RNA, 20 nt, Artificial Sequence
  Description of Artificial Sequence: Synthetic oligonucleotide
aaggaugucggucugcuacc

SEQ ID NO: 2880 - RNA, 20 nt, Artificial Sequence
  Description of Artificial Sequence: Synthetic oligonucleotide
gaaggaugucggucugcuac

SEQ ID NO: 2881 - RNA, 20 nt, Artificial Sequence
  Description of Artificial Sequence: Synthetic oligonucleotide
agaaggaugucggucugcua

SEQ ID NO: 2882 - RNA, 20 nt, Artificial Sequence
  Description of Artificial Sequence: Synthetic oligonucleotide
uaggcccagaaggaugucgg

SEQ ID NO: 2883 - RNA, 20 nt, Artificial Sequence
  Description of Artificial Sequence: Synthetic oligonucleotide
guaggcccagaaggaugucg

SEQ ID NO: 2884 - RNA, 20 nt, Artificial Sequence
  Description of Artificial Sequence: Synthetic oligonucleotide
uguaggcccagaaggauguc

SEQ ID NO: 2885 - RNA, 20 nt, Artificial Sequence
  Description of Artificial Sequence: Synthetic oligonucleotide
cuguaggcccagaaggaugu

SEQ ID NO: 2886 - RNA, 20 nt, Artificial Sequence
  Description of Artificial Sequence: Synthetic oligonucleotide
ccuguaggcccagaaggaug

SEQ ID NO: 2887 - RNA, 20 nt, Artificial Sequence
  Description of Artificial Sequence: Synthetic oligonucleotide
accuguaggcccagaaggau

SEQ ID NO: 2888 - RNA, 20 nt, Artificial Sequence
  Description of Artificial Sequence: Synthetic oligonucleotide
cuucucaucgggcaucacag

SEQ ID NO: 2889 - RNA, 20 nt, Artificial Sequence
  Description of Artificial Sequence: Synthetic oligonucleotide
ccuucucaucgggcaucaca

SEQ ID NO: 2890 - RNA, 20 nt, Artificial Sequence
  Description of Artificial Sequence: Synthetic oligonucleotide
accuucucaucgggcaucac

SEQ ID NO: 2891 - RNA, 20 nt, Artificial Sequence
  Description of Artificial Sequence: Synthetic oligonucleotide
caccuucucaucgggcauca

SEQ ID NO: 2892 - RNA, 20 nt, Artificial Sequence
  Description of Artificial Sequence: Synthetic oligonucleotide
gcaccuucucaucgggcauc

SEQ ID NO: 2893 - RNA, 20 nt, Artificial Sequence
  Description of Artificial Sequence: Synthetic oligonucleotide
ggcaccuucucaucgggcau

SEQ ID NO: 2894 - RNA, 20 nt, Artificial Sequence
  Description of Artificial Sequence: Synthetic oligonucleotide
uggcaccuucucaucgggca

SEQ ID NO: 2895 - RNA, 20 nt, Artificial Sequence
  Description of Artificial Sequence: Synthetic oligonucleotide
auggcaccuucucaucgggc

SEQ ID NO: 2896 - RNA, 20 nt, Artificial Sequence
  Description of Artificial Sequence: Synthetic oligonucleotide
cauggcaccuucucaucggg

SEQ ID NO: 2897 - RNA, 20 nt, Artificial Sequence
  Description of Artificial Sequence: Synthetic oligonucleotide
gcauggcaccuucucaucgg

SEQ ID NO: 2898 - RNA, 20 nt, Artificial Sequence
  Description of Artificial Sequence: Synthetic oligonucleotide
ggcauggcaccuucucaucg

SEQ ID NO: 2899 - RNA, 20 nt, Artificial Sequence
  Description of Artificial Sequence: Synthetic oligonucleotide
gaggcauggcaccuucucau

SEQ ID NO: 2900 - RNA, 20 nt, Artificial Sequence
  Description of Artificial Sequence: Synthetic oligonucleotide
ggaggcauggcaccuucuca

SEQ ID NO: 2901 - RNA, 20 nt, Artificial Sequence
  Description of Artificial Sequence: Synthetic oligonucleotide
gacucccaggcagaaaagag

SEQ ID NO: 2902 - RNA, 20 nt, Artificial Sequence
  Description of Artificial Sequence: Synthetic oligonucleotide
ggacucccaggcagaaaaga

SEQ ID NO: 2903 - RNA, 20 nt, Artificial Sequence
  Description of Artificial Sequence: Synthetic oligonucleotide
aggacucccaggcagaaaag

SEQ ID NO: 2904 - RNA, 20 nt, Artificial Sequence
  Description of Artificial Sequence: Synthetic oligonucleotide
ucaggacucccaggcagaaa

SEQ ID NO: 2905 - RNA, 20 nt, Artificial Sequence
  Description of Artificial Sequence: Synthetic oligonucleotide
gaagucaggacucccaggca

SEQ ID NO: 2906 - RNA, 20 nt, Artificial Sequence
  Description of Artificial Sequence: Synthetic oligonucleotide
guggaagucaggacucccag

SEQ ID NO: 2907 - RNA, 20 nt, Artificial Sequence
  Description of Artificial Sequence: Synthetic oligonucleotide
ucguggaagucaggacuccc

SEQ ID NO: 2908 - RNA, 20 nt, Artificial Sequence
  Description of Artificial Sequence: Synthetic oligonucleotide
cucguggaagucaggacucc

SEQ ID NO: 2909 - RNA, 20 nt, Artificial Sequence
  Description of Artificial Sequence: Synthetic oligonucleotide
ccucguggaagucaggacuc

SEQ ID NO: 2910 - RNA, 20 nt, Artificial Sequence
  Description of Artificial Sequence: Synthetic oligonucleotide
uggguccucguggaagucag

SEQ ID NO: 2911 - RNA, 20 nt, Artificial Sequence
  Description of Artificial Sequence: Synthetic oligonucleotide
cuggguccucguggaaguca

SEQ ID NO: 2912 - RNA, 20 nt, Artificial Sequence
  Description of Artificial Sequence: Synthetic oligonucleotide
ucuggguccucguggaaguc

SEQ ID NO: 2913 - RNA, 20 nt, Artificial Sequence
  Description of Artificial Sequence: Synthetic oligonucleotide
gucuggguccucguggaagu

SEQ ID NO: 2914 - RNA, 20 nt, Artificial Sequence
  Description of Artificial Sequence: Synthetic oligonucleotide
aagaaggaguuguguuugag

SEQ ID NO: 2915 - RNA, 20 nt, Artificial Sequence
  Description of Artificial Sequence: Synthetic oligonucleotide
ccaagaaggaguuguguuug

SEQ ID NO: 2916 - RNA, 20 nt, Artificial Sequence
  Description of Artificial Sequence: Synthetic oligonucleotide
guuccaagaaggaguugugu

SEQ ID NO: 2917 - RNA, 20 nt, Artificial Sequence
  Description of Artificial Sequence: Synthetic oligonucleotide
gguuccaagaaggaguugug

SEQ ID NO: 2918 - RNA, 20 nt, Artificial Sequence
  Description of Artificial Sequence: Synthetic oligonucleotide
caggucaacugacugggagc

SEQ ID NO: 2919 - RNA, 20 nt, Artificial Sequence
  Description of Artificial Sequence: Synthetic oligonucleotide
ugccuguuuaccacugagcu

SEQ ID NO: 2920 - RNA, 20 nt, Artificial Sequence
  Description of Artificial Sequence: Synthetic oligonucleotide
augccuguuuaccacugagc

SEQ ID NO: 2921 - RNA, 20 nt, Artificial Sequence
  Description of Artificial Sequence: Synthetic oligonucleotide
uaugccuguuuaccacugag

SEQ ID NO: 2922 - RNA, 20 nt, Artificial Sequence
  Description of Artificial Sequence: Synthetic oligonucleotide
uuaugccuguuuaccacuga

SEQ ID NO: 2923 - RNA, 20 nt, Artificial Sequence
  Description of Artificial Sequence: Synthetic oligonucleotide
uuuaugccuguuuaccacug

SEQ ID NO: 2924 - RNA, 20 nt, Artificial Sequence
  Description of Artificial Sequence: Synthetic oligonucleotide
cuuuaugccuguuuaccacu

SEQ ID NO: 2925 - RNA, 20 nt, Artificial Sequence
  Description of Artificial Sequence: Synthetic oligonucleotide
acuuuaugccuguuuaccac

SEQ ID NO: 2926 - RNA, 20 nt, Artificial Sequence
  Description of Artificial Sequence: Synthetic oligonucleotide
uagagauagugacagccugg

SEQ ID NO: 2927 - RNA, 20 nt, Artificial Sequence
  Description of Artificial Sequence: Synthetic oligonucleotide
guagagauagugacagccug

SEQ ID NO: 2928 - RNA, 20 nt, Artificial Sequence
  Description of Artificial Sequence: Synthetic oligonucleotide
uggugguagagauagugaca

SEQ ID NO: 2929 - RNA, 20 nt, Artificial Sequence
  Description of Artificial Sequence: Synthetic oligonucleotide
guggugguagagauagugac

SEQ ID NO: 2930 - RNA, 20 nt, Artificial Sequence
  Description of Artificial Sequence: Synthetic oligonucleotide
uagaggaguggugguagaga

SEQ ID NO: 2931 - RNA, 20 nt, Artificial Sequence
  Description of Artificial Sequence: Synthetic oligonucleotide
acuagaggaguggugguaga

SEQ ID NO: 2932 - RNA, 20 nt, Artificial Sequence
  Description of Artificial Sequence: Synthetic oligonucleotide
agacuagaggagugguggua

SEQ ID NO: 2933 - RNA, 20 nt, Artificial Sequence
  Description of Artificial Sequence: Synthetic oligonucleotide
cagacuagaggagugguggu

SEQ ID NO: 2934 - RNA, 20 nt, Artificial Sequence
  Description of Artificial Sequence: Synthetic oligonucleotide
ccagacuagaggaguggugg

SEQ ID NO: 2935 - RNA, 20 nt, Artificial Sequence
  Description of Artificial Sequence: Synthetic oligonucleotide
gccagacuagaggaguggug

SEQ ID NO: 2936 - RNA, 20 nt, Artificial Sequence
  Description of Artificial Sequence: Synthetic oligonucleotide
ggccagacuagaggaguggu

SEQ ID NO: 2937 - RNA, 20 nt, Artificial Sequence
  Description of Artificial Sequence: Synthetic oligonucleotide
gcccagaugugcuagaaugg

SEQ ID NO: 2938 - RNA, 20 nt, Artificial Sequence
  Description of Artificial Sequence: Synthetic oligonucleotide
ugcccagaugugcuagaaug

SEQ ID NO: 2939 - RNA, 20 nt, Artificial Sequence
  Description of Artificial Sequence: Synthetic oligonucleotide
uugcccagaugugcuagaau

SEQ ID NO: 2940 - RNA, 20 nt, Artificial Sequence
  Description of Artificial Sequence: Synthetic oligonucleotide
uuugcccagaugugcuagaa

SEQ ID NO: 2941 - RNA, 20 nt, Artificial Sequence
  Description of Artificial Sequence: Synthetic oligonucleotide
uuuugcccagaugugcuaga

SEQ ID NO: 2942 - RNA, 20 nt, Artificial Sequence
  Description of Artificial Sequence: Synthetic oligonucleotide
ccaguuuugcccagaugugc

SEQ ID NO: 2943 - RNA, 20 nt, Artificial Sequence
  Description of Artificial Sequence: Synthetic oligonucleotide
auccaguuuugcccagaugu

SEQ ID NO: 2944 - RNA, 20 nt, Artificial Sequence
  Description of Artificial Sequence: Synthetic oligonucleotide
ccauccaguuuugcccagau

SEQ ID NO: 2945 - RNA, 20 nt, Artificial Sequence
  Description of Artificial Sequence: Synthetic oligonucleotide
caccauccaguuuugcccag

SEQ ID NO: 2946 - RNA, 20 nt, Artificial Sequence
  Description of Artificial Sequence: Synthetic oligonucleotide
ccaccauccaguuuugccca

SEQ ID NO: 2947 - RNA, 20 nt, Artificial Sequence
  Description of Artificial Sequence: Synthetic oligonucleotide
cccaccauccaguuuugccc

SEQ ID NO: 2948 - RNA, 20 nt, Artificial Sequence
  Description of Artificial Sequence: Synthetic oligonucleotide
uugcucccagcuugguaagu

SEQ ID NO: 2949 - RNA, 20 nt, Artificial Sequence
  Description of Artificial Sequence: Synthetic oligonucleotide
gcuugcucccagcuugguaa

SEQ ID NO: 2950 - RNA, 20 nt, Artificial Sequence
  Description of Artificial Sequence: Synthetic oligonucleotide
auccugcuugcucccagcuu

SEQ ID NO: 2951 - RNA, 20 nt, Artificial Sequence
  Description of Artificial Sequence: Synthetic oligonucleotide
aauccugcuugcucccagcu

SEQ ID NO: 2952 - RNA, 20 nt, Artificial Sequence
  Description of Artificial Sequence: Synthetic oligonucleotide
caauccugcuugcucccagc

SEQ ID NO: 2953 - RNA, 20 nt, Artificial Sequence
  Description of Artificial Sequence: Synthetic oligonucleotide
ccaauccugcuugcucccag

SEQ ID NO: 2954 - RNA, 20 nt, Artificial Sequence
  Description of Artificial Sequence: Synthetic oligonucleotide
aaccuuucagcuucuccagg

SEQ ID NO: 2955 - RNA, 20 nt, Artificial Sequence
  Description of Artificial Sequence: Synthetic oligonucleotide
uaaccuuucagcuucuccag

SEQ ID NO: 2956 - RNA, 20 nt, Artificial Sequence
  Description of Artificial Sequence: Synthetic oligonucleotide
uuaaccuuucagcuucucca

SEQ ID NO: 2957 - RNA, 20 nt, Artificial Sequence
  Description of Artificial Sequence: Synthetic oligonucleotide
acugcugcuuaaccuuucag

SEQ ID NO: 2958 - RNA, 20 nt, Artificial Sequence
  Description of Artificial Sequence: Synthetic oligonucleotide
uacugcugcuuaaccuuuca

SEQ ID NO: 2959 - RNA, 20 nt, Artificial Sequence
  Description of Artificial Sequence: Synthetic oligonucleotide
cuacugcugcuuaaccuuuc

SEQ ID NO: 2960 - RNA, 20 nt, Artificial Sequence
  Description of Artificial Sequence: Synthetic oligonucleotide
ccuacugcugcuuaaccuuu

SEQ ID NO: 2961 - RNA, 20 nt, Artificial Sequence
  Description of Artificial Sequence: Synthetic oligonucleotide
gccuacugcugcuuaaccuu

SEQ ID NO: 2962 - RNA, 20 nt, Artificial Sequence
  Description of Artificial Sequence: Synthetic oligonucleotide
caggacaggaguaggcaccu

SEQ ID NO: 2963 - RNA, 20 nt, Artificial Sequence
  Description of Artificial Sequence: Synthetic oligonucleotide
acaggacaggaguaggcacc

SEQ ID NO: 2964 - RNA, 20 nt, Artificial Sequence
  Description of Artificial Sequence: Synthetic oligonucleotide
gcacaggacaggaguaggca

SEQ ID NO: 2965 - RNA, 20 nt, Artificial Sequence
  Description of Artificial Sequence: Synthetic oligonucleotide
auaggcacaggacaggagua

SEQ ID NO: 2966 - RNA, 20 nt, Artificial Sequence
  Description of Artificial Sequence: Synthetic oligonucleotide
gauaggcacaggacaggagu

SEQ ID NO: 2967 - RNA, 20 nt, Artificial Sequence
  Description of Artificial Sequence: Synthetic oligonucleotide
ugauaggcacaggacaggag

SEQ ID NO: 2968 - RNA, 20 nt, Artificial Sequence
  Description of Artificial Sequence: Synthetic oligonucleotide
acccucugcaaaugugauag

SEQ ID NO: 2969 - RNA, 20 nt, Artificial Sequence
  Description of Artificial Sequence: Synthetic oligonucleotide
cuuacccucugcaaauguga

SEQ ID NO: 2970 - RNA, 20 nt, Artificial Sequence
  Description of Artificial Sequence: Synthetic oligonucleotide
gucuuacccucugcaaaugu

SEQ ID NO: 2971 - RNA, 20 nt, Artificial Sequence
  Description of Artificial Sequence: Synthetic oligonucleotide
ugucuuacccucugcaaaug

SEQ ID NO: 2972 - RNA, 20 nt, Artificial Sequence
  Description of Artificial Sequence: Synthetic oligonucleotide
uugucuuacccucugcaaau

SEQ ID NO: 2973 - RNA, 20 nt, Artificial Sequence
  Description of Artificial Sequence: Synthetic oligonucleotide
cuugucuuacccucugcaaa

SEQ ID NO: 2974 - RNA, 20 nt, Artificial Sequence
  Description of Artificial Sequence: Synthetic oligonucleotide
ucuugucuuacccucugcaa

SEQ ID NO: 2975 - RNA, 20 nt, Artificial Sequence
  Description of Artificial Sequence: Synthetic oligonucleotide
cauucuugucuuacccucug

SEQ ID NO: 2976 - RNA, 20 nt, Artificial Sequence
  Description of Artificial Sequence: Synthetic oligonucleotide
cccauucuugucuuacccuc

SEQ ID NO: 2977 - RNA, 20 nt, Artificial Sequence
  Description of Artificial Sequence: Synthetic oligonucleotide
gagccucaucuugucccucc

SEQ ID NO: 2978 - RNA, 20 nt, Artificial Sequence
  Description of Artificial Sequence: Synthetic oligonucleotide
ugagccucaucuugucccuc

SEQ ID NO: 2979 - RNA, 20 nt, Artificial Sequence
  Description of Artificial Sequence: Synthetic oligonucleotide
accacgcagucaaccuucug

SEQ ID NO: 2980 - RNA, 20 nt, Artificial Sequence
  Description of Artificial Sequence: Synthetic oligonucleotide
uaccacgcagucaaccuucu

SEQ ID NO: 2981 - RNA, 20 nt, Artificial Sequence
  Description of Artificial Sequence: Synthetic oligonucleotide
cuaccacgcagucaaccuuc

SEQ ID NO: 2982 - RNA, 20 nt, Artificial Sequence
  Description of Artificial Sequence: Synthetic oligonucleotide
ccuaccacgcagucaaccuu

SEQ ID NO: 2983 - RNA, 20 nt, Artificial Sequence
  Description of Artificial Sequence: Synthetic oligonucleotide
cccuaccacgcagucaaccu

SEQ ID NO: 2984 - RNA, 20 nt, Artificial Sequence
  Description of Artificial Sequence: Synthetic oligonucleotide
uugccuucggcuugcucugg

SEQ ID NO: 2985 - RNA, 20 nt, Artificial Sequence
  Description of Artificial Sequence: Synthetic oligonucleotide
cuugccuucggcuugcucug

SEQ ID NO: 2986 - RNA, 20 nt, Artificial Sequence
  Description of Artificial Sequence: Synthetic oligonucleotide
gcuugccuucggcuugcucu

SEQ ID NO: 2987 - RNA, 20 nt, Artificial Sequence
  Description of Artificial Sequence: Synthetic oligonucleotide
ugcuugccuucggcuugcuc

SEQ ID NO: 2988 - RNA, 20 nt, Artificial Sequence
  Description of Artificial Sequence: Synthetic oligonucleotide
gugcuugccuucggcuugcu

SEQ ID NO: 2989 - RNA, 20 nt, Artificial Sequence
  Description of Artificial Sequence: Synthetic oligonucleotide
ucgugcuugccuucggcuug

SEQ ID NO: 2990 - RNA, 20 nt, Artificial Sequence
  Description of Artificial Sequence: Synthetic oligonucleotide
aucgugcuugccuucggcuu

SEQ ID NO: 2991 - RNA, 20 nt, Artificial Sequence
  Description of Artificial Sequence: Synthetic oligonucleotide
caucgugcuugccuucggcu

SEQ ID NO: 2992 - RNA, 20 nt, Artificial Sequence
  Description of Artificial Sequence: Synthetic oligonucleotide
agcgccaucgugcuugccuu

SEQ ID NO: 2993 - RNA, 20 nt, Artificial Sequence
  Description of Artificial Sequence: Synthetic oligonucleotide
uggugagcgccaucgugcuu

SEQ ID NO: 2994 - RNA, 20 nt, Artificial Sequence
  Description of Artificial Sequence: Synthetic oligonucleotide
cugaugcucggcugcuacag

SEQ ID NO: 2995 - RNA, 20 nt, Artificial Sequence
  Description of Artificial Sequence: Synthetic oligonucleotide
gcugaugcucggcugcuaca

SEQ ID NO: 2996 - RNA, 20 nt, Artificial Sequence
  Description of Artificial Sequence: Synthetic oligonucleotide
uuucgggcugaugcucggcu

SEQ ID NO: 2997 - RNA, 20 nt, Artificial Sequence
  Description of Artificial Sequence: Synthetic oligonucleotide
uccuuucgggcugaugcucg

SEQ ID NO: 2998 - RNA, 20 nt, Artificial Sequence
  Description of Artificial Sequence: Synthetic oligonucleotide
uuccuuucgggcugaugcuc

SEQ ID NO: 2999 - RNA, 20 nt, Artificial Sequence
  Description of Artificial Sequence: Synthetic oligonucleotide
cuuccuuucgggcugaugcu

SEQ ID NO: 3000 - RNA, 20 nt, Artificial Sequence
  Description of Artificial Sequence: Synthetic oligonucleotide
gcuuccuuucgggcugaugc

SEQ ID NO: 3001 - RNA, 20 nt, Artificial Sequence
  Description of Artificial Sequence: Synthetic oligonucleotide
ugcuuccuuucgggcugaug

SEQ ID NO: 3002 - RNA, 20 nt, Artificial Sequence
  Description of Artificial Sequence: Synthetic oligonucleotide
gugcuuccuuucgggcugau

SEQ ID NO: 3003 - RNA, 20 nt, Artificial Sequence
  Description of Artificial Sequence: Synthetic oligonucleotide
cgugcuuccuuucgggcuga

SEQ ID NO: 3004 - RNA, 20 nt, Artificial Sequence
  Description of Artificial Sequence: Synthetic oligonucleotide
ucgugcuuccuuucgggcug

SEQ ID NO: 3005 - RNA, 20 nt, Artificial Sequence
  Description of Artificial Sequence: Synthetic oligonucleotide
uucgugcuuccuuucgggcu

SEQ ID NO: 3006 - RNA, 20 nt, Artificial Sequence
  Description of Artificial Sequence: Synthetic oligonucleotide
uuucgugcuuccuuucgggc

SEQ ID NO: 3007 - RNA, 20 nt, Artificial Sequence
  Description of Artificial Sequence: Synthetic oligonucleotide
cuuucgugcuuccuuucggg

SEQ ID NO: 3008 - RNA, 20 nt, Artificial Sequence
  Description of Artificial Sequence: Synthetic oligonucleotide
gcuuucgugcuuccuuucgg

SEQ ID NO: 3009 - RNA, 20 nt, Artificial Sequence
  Description of Artificial Sequence: Synthetic oligonucleotide
auguacgccagcgugcugcu

SEQ ID NO: 3010 - RNA, 20 nt, Artificial Sequence
  Description of Artificial Sequence: Synthetic oligonucleotide
ucagcauguacgccagcgug

SEQ ID NO: 3011 - RNA, 20 nt, Artificial Sequence
  Description of Artificial Sequence: Synthetic oligonucleotide
aggcgguguacuacgugugc

SEQ ID NO: 3012 - RNA, 20 nt, Artificial Sequence
  Description of Artificial Sequence: Synthetic oligonucleotide
aaggcgguguacuacgugug

SEQ ID NO: 3013 - RNA, 20 nt, Artificial Sequence
  Description of Artificial Sequence: Synthetic oligonucleotide
caaggcgguguacuacgugu

SEQ ID NO: 3014 - RNA, 20 nt, Artificial Sequence
  Description of Artificial Sequence: Synthetic oligonucleotide
gcaaggcgguguacuacgug

SEQ ID NO: 3015 - RNA, 20 nt, Artificial Sequence
  Description of Artificial Sequence: Synthetic oligonucleotide
ugcaaggcgguguacuacgu

SEQ ID NO: 3016 - RNA, 20 nt, Artificial Sequence
  Description of Artificial Sequence: Synthetic oligonucleotide
cugcaaggcgguguacuacg

SEQ ID NO: 3017 - RNA, 20 nt, Artificial Sequence
  Description of Artificial Sequence: Synthetic oligonucleotide
gcugcaaggcgguguacuac

SEQ ID NO: 3018 - RNA, 20 nt, Artificial Sequence
  Description of Artificial Sequence: Synthetic oligonucleotide
ggcugcaaggcgguguacua

SEQ ID NO: 3019 - RNA, 20 nt, Artificial Sequence
  Description of Artificial Sequence: Synthetic oligonucleotide
gcucuuuguggccuuccuga

SEQ ID NO: 3020 - RNA, 20 nt, Artificial Sequence
  Description of Artificial Sequence: Synthetic oligonucleotide
cgcucuuuguggccuuccug

SEQ ID NO: 3021 - RNA, 20 nt, Artificial Sequence
  Description of Artificial Sequence: Synthetic oligonucleotide
agaaguccucacuguccacu

SEQ ID NO: 3022 - RNA, 20 nt, Artificial Sequence
  Description of Artificial Sequence: Synthetic oligonucleotide
aagaaguccucacuguccac

SEQ ID NO: 3023 - RNA, 20 nt, Artificial Sequence
  Description of Artificial Sequence: Synthetic oligonucleotide
gaagaaguccucacugucca

SEQ ID NO: 3024 - RNA, 20 nt, Artificial Sequence
  Description of Artificial Sequence: Synthetic oligonucleotide
ggaagaaguccucacugucc

SEQ ID NO: 3025 - RNA, 20 nt, Artificial Sequence
  Description of Artificial Sequence: Synthetic oligonucleotide
uggaagaaguccucacuguc

SEQ ID NO: 3026 - RNA, 20 nt, Artificial Sequence
  Description of Artificial Sequence: Synthetic oligonucleotide
cuggaagaaguccucacugu

SEQ ID NO: 3027 - RNA, 20 nt, Artificial Sequence
  Description of Artificial Sequence: Synthetic oligonucleotide
agcuggaagaaguccucacu

SEQ ID NO: 3028 - RNA, 20 nt, Artificial Sequence
  Description of Artificial Sequence: Synthetic oligonucleotide
acugcaacaccaucaggcac

SEQ ID NO: 3029 - RNA, 20 nt, Artificial Sequence
  Description of Artificial Sequence: Synthetic oligonucleotide
gacugcaacaccaucaggca

SEQ ID NO: 3030 - RNA, 20 nt, Artificial Sequence
  Description of Artificial Sequence: Synthetic oligonucleotide
agacugcaacaccaucaggc

SEQ ID NO: 3031 - RNA, 20 nt, Artificial Sequence
  Description of Artificial Sequence: Synthetic oligonucleotide
cagacugcaacaccaucagg

SEQ ID NO: 3032 - RNA, 20 nt, Artificial Sequence
  Description of Artificial Sequence: Synthetic oligonucleotide
ccagacugcaacaccaucag

SEQ ID NO: 3033 - RNA, 20 nt, Artificial Sequence
  Description of Artificial Sequence: Synthetic oligonucleotide
gaccagacugcaacaccauc

SEQ ID NO: 3034 - RNA, 20 nt, Artificial Sequence
  Description of Artificial Sequence: Synthetic oligonucleotide
cucugaccagacugcaacac

SEQ ID NO: 3035 - RNA, 20 nt, Artificial Sequence
  Description of Artificial Sequence: Synthetic oligonucleotide
agcucugaccagacugcaac

SEQ ID NO: 3036 - RNA, 20 nt, Artificial Sequence
  Description of Artificial Sequence: Synthetic oligonucleotide
ccagcucugaccagacugca

SEQ ID NO: 3037 - RNA, 20 nt, Artificial Sequence
  Description of Artificial Sequence: Synthetic oligonucleotide
uguagggcuccagcucugac

SEQ ID NO: 3038 - RNA, 20 nt, Artificial Sequence
  Description of Artificial Sequence: Synthetic oligonucleotide
cuuguagggcuccagcucug

SEQ ID NO: 3039 - RNA, 20 nt, Artificial Sequence
  Description of Artificial Sequence: Synthetic oligonucleotide
ccuuguagggcuccagcucu

SEQ ID NO: 3040 - RNA, 20 nt, Artificial Sequence
  Description of Artificial Sequence: Synthetic oligonucleotide
acaggcauuggaagcagccc

SEQ ID NO: 3041 - RNA, 20 nt, Artificial Sequence
  Description of Artificial Sequence: Synthetic oligonucleotide
gacaggcauuggaagcagcc

SEQ ID NO: 3042 - RNA, 20 nt, Artificial Sequence
  Description of Artificial Sequence: Synthetic oligonucleotide
aaggacaggcauuggaagca

SEQ ID NO: 3043 - RNA, 20 nt, Artificial Sequence
  Description of Artificial Sequence: Synthetic oligonucleotide
aaaggacaggcauuggaagc

SEQ ID NO: 3044 - RNA, 20 nt, Artificial Sequence
  Description of Artificial Sequence: Synthetic oligonucleotide
uaaaggacaggcauuggaag

SEQ ID NO: 3045 - RNA, 20 nt, Artificial Sequence
  Description of Artificial Sequence: Synthetic oligonucleotide
cuaaaggacaggcauuggaa

SEQ ID NO: 3046 - RNA, 20 nt, Artificial Sequence
  Description of Artificial Sequence: Synthetic oligonucleotide
gcucuaaaggacaggcauug

SEQ ID NO: 3047 - RNA, 20 nt, Artificial Sequence
  Description of Artificial Sequence: Synthetic oligonucleotide
agcucuaaaggacaggcauu

SEQ ID NO: 3048 - RNA, 20 nt, Artificial Sequence
  Description of Artificial Sequence: Synthetic oligonucleotide
aagcucuaaaggacaggcau

SEQ ID NO: 3049 - RNA, 20 nt, Artificial Sequence
  Description of Artificial Sequence: Synthetic oligonucleotide
aaagcucuaaaggacaggca

SEQ ID NO: 3050 - RNA, 20 nt, Artificial Sequence
  Description of Artificial Sequence: Synthetic oligonucleotide
gaaagcucuaaaggacaggc

SEQ ID NO: 3051 - RNA, 20 nt, Artificial Sequence
  Description of Artificial Sequence: Synthetic oligonucleotide
cgggaaagcucuaaaggaca

SEQ ID NO: 3052 - RNA, 20 nt, Artificial Sequence
  Description of Artificial Sequence: Synthetic oligonucleotide
ccgggaaagcucuaaaggac

SEQ ID NO: 3053 - RNA, 20 nt, Artificial Sequence
  Description of Artificial Sequence: Synthetic oligonucleotide
aggguuaagcuagagaggaa

SEQ ID NO: 3054 - RNA, 20 nt, Artificial Sequence
  Description of Artificial Sequence: Synthetic oligonucleotide
ucaggguuaagcuagagagg

SEQ ID NO: 3055 - RNA, 20 nt, Artificial Sequence
  Description of Artificial Sequence: Synthetic oligonucleotide
gaucaggguuaagcuagaga

SEQ ID NO: 3056 - RNA, 20 nt, Artificial Sequence
  Description of Artificial Sequence: Synthetic oligonucleotide
ggaucaggguuaagcuagag

SEQ ID NO: 3057 - RNA, 20 nt, Artificial Sequence
  Description of Artificial Sequence: Synthetic oligonucleotide
aggaucaggguuaagcuaga

SEQ ID NO: 3058 - RNA, 20 nt, Artificial Sequence
  Description of Artificial Sequence: Synthetic oligonucleotide
cccaggaucaggguuaagcu

SEQ ID NO: 3059 - RNA, 20 nt, Artificial Sequence
  Description of Artificial Sequence: Synthetic oligonucleotide
caacuccuccugcaccuggu

SEQ ID NO: 3060 - RNA, 20 nt, Artificial Sequence
  Description of Artificial Sequence: Synthetic oligonucleotide
acaacuccuccugcaccugg

SEQ ID NO: 3061 - RNA, 20 nt, Artificial Sequence
  Description of Artificial Sequence: Synthetic oligonucleotide
gacaauuccacaacuccucc

SEQ ID NO: 3062 - RNA, 20 nt, Artificial Sequence
  Description of Artificial Sequence: Synthetic oligonucleotide
ugacaauuccacaacuccuc

SEQ ID NO: 3063 - RNA, 20 nt, Artificial Sequence
  Description of Artificial Sequence: Synthetic oligonucleotide
uugacaauuccacaacuccu

SEQ ID NO: 3064 - RNA, 20 nt, Artificial Sequence
  Description of Artificial Sequence: Synthetic oligonucleotide
cuugacaauuccacaacucc

SEQ ID NO: 3065 - RNA, 20 nt, Artificial Sequence
  Description of Artificial Sequence: Synthetic oligonucleotide
uccuugacaauuccacaacu

SEQ ID NO: 3066 - RNA, 20 nt, Artificial Sequence
  Description of Artificial Sequence: Synthetic oligonucleotide
auccuugacaauuccacaac

SEQ ID NO: 3067 - RNA, 20 nt, Artificial Sequence
  Description of Artificial Sequence: Synthetic oligonucleotide
cauccuugacaauuccacaa

SEQ ID NO: 3068 - RNA, 20 nt, Artificial Sequence
  Description of Artificial Sequence: Synthetic oligonucleotide
acauccuugacaauuccaca

SEQ ID NO: 3069 - RNA, 20 nt, Artificial Sequence
  Description of Artificial Sequence: Synthetic oligonucleotide
gacauccuugacaauuccac

SEQ ID NO: 3070 - RNA, 20 nt, Artificial Sequence
  Description of Artificial Sequence: Synthetic oligonucleotide
ugacauccuugacaauucca

SEQ ID NO: 3071 - RNA, 20 nt, Artificial Sequence
  Description of Artificial Sequence: Synthetic oligonucleotide
ugugugacauccuugacaau

SEQ ID NO: 3072 - RNA, 20 nt, Artificial Sequence
  Description of Artificial Sequence: Synthetic oligonucleotide
acugugugacauccuugaca

SEQ ID NO: 3073 - RNA, 20 nt, Artificial Sequence
  Description of Artificial Sequence: Synthetic oligonucleotide
acuuucuguccacuguguga

SEQ ID NO: 3074 - RNA, 20 nt, Artificial Sequence
  Description of Artificial Sequence: Synthetic oligonucleotide
ccucgcuuggacuuucuguc

SEQ ID NO: 3075 - RNA, 20 nt, Artificial Sequence
  Description of Artificial Sequence: Synthetic oligonucleotide
cccucgcuuggacuuucugu

SEQ ID NO: 3076 - RNA, 20 nt, Artificial Sequence
  Description of Artificial Sequence: Synthetic oligonucleotide
ucccucgcuuggacuuucug

SEQ ID NO: 3077 - RNA, 20 nt, Artificial Sequence
  Description of Artificial Sequence: Synthetic oligonucleotide
cucccucgcuuggacuuucu

SEQ ID NO: 3078 - RNA, 20 nt, Artificial Sequence
  Description of Artificial Sequence: Synthetic oligonucleotide
ccucccucgcuuggacuuuc

SEQ ID NO: 3079 - RNA, 20 nt, Artificial Sequence
  Description of Artificial Sequence: Synthetic oligonucleotide
cccucccucgcuuggacuuu

SEQ ID NO: 3080 - RNA, 20 nt, Artificial Sequence
  Description of Artificial Sequence: Synthetic oligonucleotide
uccaucagcacugggucaga

SEQ ID NO: 3081 - RNA, 20 nt, Artificial Sequence
  Description of Artificial Sequence: Synthetic oligonucleotide
accacuaaucuccaucagca

SEQ ID NO: 3082 - RNA, 20 nt, Artificial Sequence
  Description of Artificial Sequence: Synthetic oligonucleotide
caccacuaaucuccaucagc

SEQ ID NO: 3083 - RNA, 20 nt, Artificial Sequence
  Description of Artificial Sequence: Synthetic oligonucleotide
ccaccacuaaucuccaucag

SEQ ID NO: 3084 - RNA, 20 nt, Artificial Sequence
  Description of Artificial Sequence: Synthetic oligonucleotide
cccaccacuaaucuccauca

SEQ ID NO: 3085 - RNA, 20 nt, Artificial Sequence
  Description of Artificial Sequence: Synthetic oligonucleotide
accagacacccaccacuaau

SEQ ID NO: 3086 - RNA, 20 nt, Artificial Sequence
  Description of Artificial Sequence: Synthetic oligonucleotide
uaccagacacccaccacuaa

SEQ ID NO: 3087 - RNA, 20 nt, Artificial Sequence
  Description of Artificial Sequence: Synthetic oligonucleotide
cucauaccagacacccacca

SEQ ID NO: 3088 - RNA, 20 nt, Artificial Sequence
  Description of Artificial Sequence: Synthetic oligonucleotide
ccucauaccagacacccacc

SEQ ID NO: 3089 - RNA, 20 nt, Artificial Sequence
  Description of Artificial Sequence: Synthetic oligonucleotide
uccucauaccagacacccac

SEQ ID NO: 3090 - RNA, 20 nt, Artificial Sequence
  Description of Artificial Sequence: Synthetic oligonucleotide
auccucauaccagacaccca

SEQ ID NO: 3091 - RNA, 20 nt, Artificial Sequence
  Description of Artificial Sequence: Synthetic oligonucleotide
gauccucauaccagacaccc

SEQ ID NO: 3092 - RNA, 20 nt, Artificial Sequence
  Description of Artificial Sequence: Synthetic oligonucleotide
agauccucauaccagacacc

SEQ ID NO: 3093 - RNA, 20 nt, Artificial Sequence
  Description of Artificial Sequence: Synthetic oligonucleotide
uagauccucauaccagacac

SEQ ID NO: 3094 - RNA, 20 nt, Artificial Sequence
  Description of Artificial Sequence: Synthetic oligonucleotide
guagauccucauaccagaca

SEQ ID NO: 3095 - RNA, 20 nt, Artificial Sequence
  Description of Artificial Sequence: Synthetic oligonucleotide
aguagauccucauaccagac

SEQ ID NO: 3096 - RNA, 20 nt, Artificial Sequence
  Description of Artificial Sequence: Synthetic oligonucleotide
caguagauccucauaccaga

SEQ ID NO: 3097 - RNA, 20 nt, Artificial Sequence
  Description of Artificial Sequence: Synthetic oligonucleotide
ugcaguagauccucauacca

SEQ ID NO: 3098 - RNA, 20 nt, Artificial Sequence
  Description of Artificial Sequence: Synthetic oligonucleotide
gugcaguagauccucauacc

SEQ ID NO: 3099 - RNA, 20 nt, Artificial Sequence
  Description of Artificial Sequence: Synthetic oligonucleotide
agugcaguagauccucauac

SEQ ID NO: 3100 - RNA, 20 nt, Artificial Sequence
  Description of Artificial Sequence: Synthetic oligonucleotide
acucuguaggacacccuugu

SEQ ID NO: 3101 - RNA, 20 nt, Artificial Sequence
  Description of Artificial Sequence: Synthetic oligonucleotide
cacucuguaggacacccuug

SEQ ID NO: 3102 - RNA, 20 nt, Artificial Sequence
  Description of Artificial Sequence: Synthetic oligonucleotide
ccacucuguaggacacccuu

SEQ ID NO: 3103 - RNA, 20 nt, Artificial Sequence
  Description of Artificial Sequence: Synthetic oligonucleotide
uccacucuguaggacacccu

SEQ ID NO: 3104 - RNA, 20 nt, Artificial Sequence
  Description of Artificial Sequence: Synthetic oligonucleotide
cuccacucuguaggacaccc

SEQ ID NO: 3105 - RNA, 20 nt, Artificial Sequence
  Description of Artificial Sequence: Synthetic oligonucleotide
acuccacucuguaggacacc

SEQ ID NO: 3106 - RNA, 20 nt, Artificial Sequence
  Description of Artificial Sequence: Synthetic oligonucleotide
cacuccacucuguaggacac

SEQ ID NO: 3107 - RNA, 20 nt, Artificial Sequence
  Description of Artificial Sequence: Synthetic oligonucleotide
agcacuccacucuguaggac

SEQ ID NO: 3108 - RNA, 20 nt, Artificial Sequence
  Description of Artificial Sequence: Synthetic oligonucleotide
uaugacagcacuccacucug

SEQ ID NO: 3109 - RNA, 20 nt, Artificial Sequence
  Description of Artificial Sequence: Synthetic oligonucleotide
auaugacagcacuccacucu

SEQ ID NO: 3110 - RNA, 20 nt, Artificial Sequence
  Description of Artificial Sequence: Synthetic oligonucleotide
uugcugugcuugggccucuc

SEQ ID NO: 3111 - RNA, 20 nt, Artificial Sequence
  Description of Artificial Sequence: Synthetic oligonucleotide
acgucaaaggugaaucgggc

SEQ ID NO: 3112 - RNA, 20 nt, Artificial Sequence
  Description of Artificial Sequence: Synthetic oligonucleotide
cacgucaaaggugaaucggg

SEQ ID NO: 3113 - RNA, 20 nt, Artificial Sequence
  Description of Artificial Sequence: Synthetic oligonucleotide
acacgucaaaggugaaucgg

SEQ ID NO: 3114 - RNA, 20 nt, Artificial Sequence
  Description of Artificial Sequence: Synthetic oligonucleotide
uacacgucaaaggugaaucg

SEQ ID NO: 3115 - RNA, 20 nt, Artificial Sequence
  Description of Artificial Sequence: Synthetic oligonucleotide
guacacgucaaaggugaauc

SEQ ID NO: 3116 - RNA, 20 nt, Artificial Sequence
  Description of Artificial Sequence: Synthetic oligonucleotide
ggcugccaaagaggucucga

SEQ ID NO: 3117 - RNA, 20 nt, Artificial Sequence
  Description of Artificial Sequence: Synthetic oligonucleotide
ucaggcugccaaagaggucu

SEQ ID NO: 3118 - RNA, 20 nt, Artificial Sequence
  Description of Artificial Sequence: Synthetic oligonucleotide
cauucaggcugccaaagagg

SEQ ID NO: 3119 - RNA, 20 nt, Artificial Sequence
  Description of Artificial Sequence: Synthetic oligonucleotide
gacauucaggcugccaaaga

SEQ ID NO: 3120 - RNA, 20 nt, Artificial Sequence
  Description of Artificial Sequence: Synthetic oligonucleotide
ugacauucaggcugccaaag

SEQ ID NO: 3121 - RNA, 20 nt, Artificial Sequence
  Description of Artificial Sequence: Synthetic oligonucleotide
cuuugacauucaggcugcca

SEQ ID NO: 3122 - RNA, 20 nt, Artificial Sequence
  Description of Artificial Sequence: Synthetic oligonucleotide
gcuuugacauucaggcugcc

SEQ ID NO: 3123 - RNA, 20 nt, Artificial Sequence
  Description of Artificial Sequence: Synthetic oligonucleotide
ccguagaauguggcuuugac

SEQ ID NO: 3124 - RNA, 20 nt, Artificial Sequence
  Description of Artificial Sequence: Synthetic oligonucleotide
gcccguagaauguggcuuug

SEQ ID NO: 3125 - RNA, 20 nt, Artificial Sequence
  Description of Artificial Sequence: Synthetic oligonucleotide
uagagcccguagaauguggc

SEQ ID NO: 3126 - RNA, 20 nt, Artificial Sequence
  Description of Artificial Sequence: Synthetic oligonucleotide
guagagcccguagaaugugg

SEQ ID NO: 3127 - RNA, 20 nt, Artificial Sequence
  Description of Artificial Sequence: Synthetic oligonucleotide
aguagagcccguagaaugug

SEQ ID NO: 3128 - RNA, 20 nt, Artificial Sequence
  Description of Artificial Sequence: Synthetic oligonucleotide
agaguagagcccguagaaug

SEQ ID NO: 3129 - RNA, 20 nt, Artificial Sequence
  Description of Artificial Sequence: Synthetic oligonucleotide
uagaguagagcccguagaau

SEQ ID NO: 3130 - RNA, 20 nt, Artificial Sequence
  Description of Artificial Sequence: Synthetic oligonucleotide
auagaguagagcccguagaa

SEQ ID NO: 3131 - RNA, 20 nt, Artificial Sequence
  Description of Artificial Sequence: Synthetic oligonucleotide
cauagaguagagcccguaga

SEQ ID NO: 3132 - RNA, 20 nt, Artificial Sequence
  Description of Artificial Sequence: Synthetic oligonucleotide
ucauagaguagagcccguag

SEQ ID NO: 3133 - RNA, 20 nt, Artificial Sequence
  Description of Artificial Sequence: Synthetic oligonucleotide
cucauagaguagagcccgua

SEQ ID NO: 3134 - RNA, 20 nt, Artificial Sequence
  Description of Artificial Sequence: Synthetic oligonucleotide
gaaagucacaacucauagag

SEQ ID NO: 3135 - RNA, 20 nt, Artificial Sequence
  Description of Artificial Sequence: Synthetic oligonucleotide
ccuugaaagucacaacucau

SEQ ID NO: 3136 - RNA, 20 nt, Artificial Sequence
  Description of Artificial Sequence: Synthetic oligonucleotide
aaguccuugaaagucacaac

SEQ ID NO: 3137 - RNA, 20 nt, Artificial Sequence
  Description of Artificial Sequence: Synthetic oligonucleotide
ccaaguccuugaaagucaca

SEQ ID NO: 3138 - RNA, 20 nt, Artificial Sequence
  Description of Artificial Sequence: Synthetic oligonucleotide
uucuuugggccaaguccuug

SEQ ID NO: 3139 - RNA, 20 nt, Artificial Sequence
  Description of Artificial Sequence: Synthetic oligonucleotide
uuucuuugggccaaguccuu

SEQ ID NO: 3140 - RNA, 20 nt, Artificial Sequence
  Description of Artificial Sequence: Synthetic oligonucleotide
uugauuucugaccugaguac

SEQ ID NO: 3141 - RNA, 20 nt, Artificial Sequence
  Description of Artificial Sequence: Synthetic oligonucleotide
guugauuucugaccugagua

SEQ ID NO: 3142 - RNA, 20 nt, Artificial Sequence
  Description of Artificial Sequence: Synthetic oligonucleotide
gggacuauccaacuguaggg

SEQ ID NO: 3143 - RNA, 20 nt, Artificial Sequence
  Description of Artificial Sequence: Synthetic oligonucleotide
gcaagaggacgaauuauggg

SEQ ID NO: 3144 - RNA, 20 nt, Artificial Sequence
  Description of Artificial Sequence: Synthetic oligonucleotide
ugcaagaggacgaauuaugg

SEQ ID NO: 3145 - RNA, 20 nt, Artificial Sequence
  Description of Artificial Sequence: Synthetic oligonucleotide
gugcaagaggacgaauuaug

SEQ ID NO: 3146 - RNA, 20 nt, Artificial Sequence
  Description of Artificial Sequence: Synthetic oligonucleotide
ggugcaagaggacgaauuau

SEQ ID NO: 3147 - RNA, 20 nt, Artificial Sequence
  Description of Artificial Sequence: Synthetic oligonucleotide
gggugcaagaggacgaauua

SEQ ID NO: 3148 - RNA, 20 nt, Artificial Sequence
  Description of Artificial Sequence: Synthetic oligonucleotide
ugggugcaagaggacgaauu

SEQ ID NO: 3149 - RNA, 20 nt, Artificial Sequence
  Description of Artificial Sequence: Synthetic oligonucleotide
gugggugcaagaggacgaau

SEQ ID NO: 3150 - RNA, 20 nt, Artificial Sequence
  Description of Artificial Sequence: Synthetic oligonucleotide
ggugggugcaagaggacgaa

SEQ ID NO: 3151 - RNA, 20 nt, Artificial Sequence
  Description of Artificial Sequence: Synthetic oligonucleotide
uaggugggugcaagaggacg

SEQ ID NO: 3152 - RNA, 20 nt, Artificial Sequence
  Description of Artificial Sequence: Synthetic oligonucleotide
guaggugggugcaagaggac

SEQ ID NO: 3153 - RNA, 20 nt, Artificial Sequence
  Description of Artificial Sequence: Synthetic oligonucleotide
gguaggugggugcaagagga

SEQ ID NO: 3154 - RNA, 20 nt, Artificial Sequence
  Description of Artificial Sequence: Synthetic oligonucleotide
ccacaagcaagagcuaacua

SEQ ID NO: 3155 - RNA, 20 nt, Artificial Sequence
  Description of Artificial Sequence: Synthetic oligonucleotide
acuuuccacaagcaagagcu

SEQ ID NO: 3156 - RNA, 20 nt, Artificial Sequence
  Description of Artificial Sequence: Synthetic oligonucleotide
gacuuuccacaagcaagagc

SEQ ID NO: 3157 - RNA, 20 nt, Artificial Sequence
  Description of Artificial Sequence: Synthetic oligonucleotide
ggacuuuccacaagcaagag

SEQ ID NO: 3158 - RNA, 20 nt, Artificial Sequence
  Description of Artificial Sequence: Synthetic oligonucleotide
aggacuuuccacaagcaaga

SEQ ID NO: 3159 - RNA, 20 nt, Artificial Sequence
  Description of Artificial Sequence: Synthetic oligonucleotide
gaggacuuuccacaagcaag

SEQ ID NO: 3160 - RNA, 20 nt, Artificial Sequence
  Description of Artificial Sequence: Synthetic oligonucleotide
ugaggacuuuccacaagcaa

SEQ ID NO: 3161 - RNA, 20 nt, Artificial Sequence
  Description of Artificial Sequence: Synthetic oligonucleotide
augaggacuuuccacaagca

SEQ ID NO: 3162 - RNA, 20 nt, Artificial Sequence
  Description of Artificial Sequence: Synthetic oligonucleotide
gaugaggacuuuccacaagc

SEQ ID NO: 3163 - RNA, 20 nt, Artificial Sequence
  Description of Artificial Sequence: Synthetic oligonucleotide
agaugaggacuuuccacaag

SEQ ID NO: 3164 - RNA, 20 nt, Artificial Sequence
  Description of Artificial Sequence: Synthetic oligonucleotide
gagaugaggacuuuccacaa

SEQ ID NO: 3165 - RNA, 20 nt, Artificial Sequence
  Description of Artificial Sequence: Synthetic oligonucleotide
ggagaugaggacuuuccaca

SEQ ID NO: 3166 - RNA, 20 nt, Artificial Sequence
  Description of Artificial Sequence: Synthetic oligonucleotide
ugggagaugaggacuuucca

SEQ ID NO: 3167 - RNA, 20 nt, Artificial Sequence
  Description of Artificial Sequence: Synthetic oligonucleotide
gcugggagaugaggacuuuc

SEQ ID NO: 3168 - RNA, 20 nt, Artificial Sequence
  Description of Artificial Sequence: Synthetic oligonucleotide
ucaagcugggagaugaggac

SEQ ID NO: 3169 - RNA, 20 nt, Artificial Sequence
  Description of Artificial Sequence: Synthetic oligonucleotide
aagccaucaagcugggagau

SEQ ID NO: 3170 - RNA, 20 nt, Artificial Sequence
  Description of Artificial Sequence: Synthetic oligonucleotide
gaagccaucaagcugggaga

SEQ ID NO: 3171 - RNA, 20 nt, Artificial Sequence
  Description of Artificial Sequence: Synthetic oligonucleotide
ggaggaagccaucaagcugg

SEQ ID NO: 3172 - RNA, 20 nt, Artificial Sequence
  Description of Artificial Sequence: Synthetic oligonucleotide
gggaggaagccaucaagcug

SEQ ID NO: 3173 - RNA, 20 nt, Artificial Sequence
  Description of Artificial Sequence: Synthetic oligonucleotide
aacuugggaggaagccauca

SEQ ID NO: 3174 - RNA, 20 nt, Artificial Sequence
  Description of Artificial Sequence: Synthetic oligonucleotide
aaacuugggaggaagccauc

SEQ ID NO: 3175 - RNA, 20 nt, Artificial Sequence
  Description of Artificial Sequence: Synthetic oligonucleotide
cagcaguguggagguccaac

SEQ ID NO: 3176 - RNA, 20 nt, Artificial Sequence
  Description of Artificial Sequence: Synthetic oligonucleotide
gcagcaguguggagguccaa

SEQ ID NO: 3177 - RNA, 20 nt, Artificial Sequence
  Description of Artificial Sequence: Synthetic oligonucleotide
ugcagcaguguggaggucca

SEQ ID NO: 3178 - RNA, 20 nt, Artificial Sequence
  Description of Artificial Sequence: Synthetic oligonucleotide
uugcagcaguguggaggucc

SEQ ID NO: 3179 - RNA, 20 nt, Artificial Sequence
  Description of Artificial Sequence: Synthetic oligonucleotide
gguggaggaaauucccagca

SEQ ID NO: 3180 - RNA, 20 nt, Artificial Sequence
  Description of Artificial Sequence: Synthetic oligonucleotide
acgaaggguggaggaaauuc

SEQ ID NO: 3181 - RNA, 20 nt, Artificial Sequence
  Description of Artificial Sequence: Synthetic oligonucleotide
gacgaaggguggaggaaauu

SEQ ID NO: 3182 - RNA, 20 nt, Artificial Sequence
  Description of Artificial Sequence: Synthetic oligonucleotide
augacgaaggguggaggaaa

SEQ ID NO: 3183 - RNA, 20 nt, Artificial Sequence
  Description of Artificial Sequence: Synthetic oligonucleotide
caugacgaaggguggaggaa

SEQ ID NO: 3184 - RNA, 20 nt, Artificial Sequence
  Description of Artificial Sequence: Synthetic oligonucleotide
gcaugacgaaggguggagga

SEQ ID NO: 3185 - RNA, 20 nt, Artificial Sequence
  Description of Artificial Sequence: Synthetic oligonucleotide
ugcaugacgaaggguggagg

SEQ ID NO: 3186 - RNA, 20 nt, Artificial Sequence
  Description of Artificial Sequence: Synthetic oligonucleotide
cugcaugacgaaggguggag

SEQ ID NO: 3187 - RNA, 20 nt, Artificial Sequence
  Description of Artificial Sequence: Synthetic oligonucleotide
acugcaugacgaagggugga

SEQ ID NO: 3188 - RNA, 20 nt, Artificial Sequence
  Description of Artificial Sequence: Synthetic oligonucleotide
cacugcaugacgaagggugg

SEQ ID NO: 3189 - RNA, 20 nt, Artificial Sequence
  Description of Artificial Sequence: Synthetic oligonucleotide
ccacugcaugacgaagggug

SEQ ID NO: 3190 - RNA, 20 nt, Artificial Sequence
  Description of Artificial Sequence: Synthetic oligonucleotide
uccacugcaugacgaagggu

SEQ ID NO: 3191 - RNA, 20 nt, Artificial Sequence
  Description of Artificial Sequence: Synthetic oligonucleotide
cuccacugcaugacgaaggg

SEQ ID NO: 3192 - RNA, 20 nt, Artificial Sequence
  Description of Artificial Sequence: Synthetic oligonucleotide
ccuccacugcaugacgaagg

SEQ ID NO: 3193 - RNA, 20 nt, Artificial Sequence
  Description of Artificial Sequence: Synthetic oligonucleotide
cccuccacugcaugacgaag

SEQ ID NO: 3194 - RNA, 20 nt, Artificial Sequence
  Description of Artificial Sequence: Synthetic oligonucleotide
cuuaguaggaauggaggcgg

SEQ ID NO: 3195 - RNA, 20 nt, Artificial Sequence
  Description of Artificial Sequence: Synthetic oligonucleotide
ccuuaguaggaauggaggcg

SEQ ID NO: 3196 - RNA, 20 nt, Artificial Sequence
  Description of Artificial Sequence: Synthetic oligonucleotide
cccuuaguaggaauggaggc

SEQ ID NO: 3197 - RNA, 19 nt, Artificial Sequence
  Description of Artificial Sequence: Synthetic oligonucleotide
gaccgccugcagaagguug

SEQ ID NO: 3198 - RNA, 19 nt, Artificial Sequence
  Description of Artificial Sequence: Synthetic oligonucleotide
caaccuucugcaggcgguc

SEQ ID NO: 3199 - RNA, 19 nt, Artificial Sequence
  Description of Artificial Sequence: Synthetic oligonucleotide
accgccugcagaagguuga

SEQ ID NO: 3200 - RNA, 19 nt, Artificial Sequence
  Description of Artificial Sequence: Synthetic oligonucleotide
ucaaccuucugcaggcggu

SEQ ID NO: 3201 - RNA, 19 nt, Artificial Sequence
  Description of Artificial Sequence: Synthetic oligonucleotide
ccgccugcagaagguugac

SEQ ID NO: 3202 - RNA, 19 nt, Artificial Sequence
  Description of Artificial Sequence: Synthetic oligonucleotide
gucaaccuucugcaggcgg

SEQ ID NO: 3203 - RNA, 19 nt, Artificial Sequence
  Description of Artificial Sequence: Synthetic oligonucleotide
cgccugcagaagguugacu

SEQ ID NO: 3204 - RNA, 19 nt, Artificial Sequence
  Description of Artificial Sequence: Synthetic oligonucleotide
agucaaccuucugcaggcg

SEQ ID NO: 3205 - RNA, 19 nt, Artificial Sequence
  Description of Artificial Sequence: Synthetic oligonucleotide
gccugcagaagguugacug

SEQ ID NO: 3206 - RNA, 19 nt, Artificial Sequence
  Description of Artificial Sequence: Synthetic oligonucleotide
cagucaaccuucugcaggc

SEQ ID NO: 3207 - RNA, 19 nt, Artificial Sequence
  Description of Artificial Sequence: Synthetic oligonucleotide
cagaagguugacugcgugg

SEQ ID NO: 3208 - RNA, 19 nt, Artificial Sequence
  Description of Artificial Sequence: Synthetic oligonucleotide
ccacgcagucaaccuucug

SEQ ID NO: 3209 - RNA, 19 nt, Artificial Sequence
  Description of Artificial Sequence: Synthetic oligonucleotide
agaagguugacugcguggu

SEQ ID NO: 3210 - RNA, 19 nt, Artificial Sequence
  Description of Artificial Sequence: Synthetic oligonucleotide
accacgcagucaaccuucu

SEQ ID NO: 3211 - RNA, 19 nt, Artificial Sequence
  Description of Artificial Sequence: Synthetic oligonucleotide
gaagguugacugcguggua

SEQ ID NO: 3212 - RNA, 19 nt, Artificial Sequence
  Description of Artificial Sequence: Synthetic oligonucleotide
uaccacgcagucaaccuuc

SEQ ID NO: 3213 - RNA, 19 nt, Artificial Sequence
  Description of Artificial Sequence: Synthetic oligonucleotide
aagguugacugcgugguag

SEQ ID NO: 3214 - RNA, 19 nt, Artificial Sequence
  Description of Artificial Sequence: Synthetic oligonucleotide
cuaccacgcagucaaccuu

SEQ ID NO: 3215 - RNA, 19 nt, Artificial Sequence
  Description of Artificial Sequence: Synthetic oligonucleotide
agguugacugcgugguagg

SEQ ID NO: 3216 - RNA, 19 nt, Artificial Sequence
  Description of Artificial Sequence: Synthetic oligonucleotide
ccuaccacgcagucaaccu

SEQ ID NO: 3217 - RNA, 19 nt, Artificial Sequence
  Description of Artificial Sequence: Synthetic oligonucleotide
gguugacugcgugguaggg

SEQ ID NO: 3218 - RNA, 19 nt, Artificial Sequence
  Description of Artificial Sequence: Synthetic oligonucleotide
cccuaccacgcagucaacc

SEQ ID NO: 3219 - RNA, 19 nt, Artificial Sequence
  Description of Artificial Sequence: Synthetic oligonucleotide
ccagagcaagccgaaggca

SEQ ID NO: 3220 - RNA, 19 nt, Artificial Sequence
  Description of Artificial Sequence: Synthetic oligonucleotide
ugccuucggcuugcucugg

SEQ ID NO: 3221 - RNA, 19 nt, Artificial Sequence
  Description of Artificial Sequence: Synthetic oligonucleotide
cagagcaagccgaaggcaa

SEQ ID NO: 3222 - RNA, 19 nt, Artificial Sequence
  Description of Artificial Sequence: Synthetic oligonucleotide
uugccuucggcuugcucug

SEQ ID NO: 3223 - RNA, 19 nt, Artificial Sequence
  Description of Artificial Sequence: Synthetic oligonucleotide
agagcaagccgaaggcaag

SEQ ID NO: 3224 - RNA, 19 nt, Artificial Sequence
  Description of Artificial Sequence: Synthetic oligonucleotide
cuugccuucggcuugcucu

SEQ ID NO: 3225 - RNA, 19 nt, Artificial Sequence
  Description of Artificial Sequence: Synthetic oligonucleotide
gagcaagccgaaggcaagc

SEQ ID NO: 3226 - RNA, 19 nt, Artificial Sequence
  Description of Artificial Sequence: Synthetic oligonucleotide
gcuugccuucggcuugcuc

SEQ ID NO: 3227 - RNA, 19 nt, Artificial Sequence
  Description of Artificial Sequence: Synthetic oligonucleotide
agcaagccgaaggcaagca

SEQ ID NO: 3228 - RNA, 19 nt, Artificial Sequence
  Description of Artificial Sequence: Synthetic oligonucleotide
ugcuugccuucggcuugcu

SEQ ID NO: 3229 - RNA, 19 nt, Artificial Sequence
  Description of Artificial Sequence: Synthetic oligonucleotide
gcaagccgaaggcaagcac

SEQ ID NO: 3230 - RNA, 19 nt, Artificial Sequence
  Description of Artificial Sequence: Synthetic oligonucleotide
gugcuugccuucggcuugc

SEQ ID NO: 3231 - RNA, 19 nt, Artificial Sequence
  Description of Artificial Sequence: Synthetic oligonucleotide
caagccgaaggcaagcacg

SEQ ID NO: 3232 - RNA, 19 nt, Artificial Sequence
  Description of Artificial Sequence: Synthetic oligonucleotide
cgugcuugccuucggcuug

SEQ ID NO: 3233 - RNA, 19 nt, Artificial Sequence
  Description of Artificial Sequence: Synthetic oligonucleotide
aagccgaaggcaagcacga

SEQ ID NO: 3234 - RNA, 19 nt, Artificial Sequence
  Description of Artificial Sequence: Synthetic oligonucleotide
ucgugcuugccuucggcuu

SEQ ID NO: 3235 - RNA, 19 nt, Artificial Sequence
  Description of Artificial Sequence: Synthetic oligonucleotide
agccgaaggcaagcacgau

SEQ ID NO: 3236 - RNA, 19 nt, Artificial Sequence
  Description of Artificial Sequence: Synthetic oligonucleotide
aucgugcuugccuucggcu

SEQ ID NO: 3237 - RNA, 19 nt, Artificial Sequence
  Description of Artificial Sequence: Synthetic oligonucleotide
gccgaaggcaagcacgaug

SEQ ID NO: 3238 - RNA, 19 nt, Artificial Sequence
  Description of Artificial Sequence: Synthetic oligonucleotide
caucgugcuugccuucggc

SEQ ID NO: 3239 - RNA, 19 nt, Artificial Sequence
  Description of Artificial Sequence: Synthetic oligonucleotide
aaggcaagcacgauggcgc

SEQ ID NO: 3240 - RNA, 19 nt, Artificial Sequence
  Description of Artificial Sequence: Synthetic oligonucleotide
gcgccaucgugcuugccuu

SEQ ID NO: 3241 - RNA, 19 nt, Artificial Sequence
  Description of Artificial Sequence: Synthetic oligonucleotide
aggcaagcacgauggcgcu

SEQ ID NO: 3242 - RNA, 19 nt, Artificial Sequence
  Description of Artificial Sequence: Synthetic oligonucleotide
agcgccaucgugcuugccu

SEQ ID NO: 3243 - RNA, 19 nt, Artificial Sequence
  Description of Artificial Sequence: Synthetic oligonucleotide
aagcacgauggcgcucacc

SEQ ID NO: 3244 - RNA, 19 nt, Artificial Sequence
  Description of Artificial Sequence: Synthetic oligonucleotide
ggugagcgccaucgugcuu

SEQ ID NO: 3245 - RNA, 19 nt, Artificial Sequence
  Description of Artificial Sequence: Synthetic oligonucleotide
agcacgauggcgcucacca

SEQ ID NO: 3246 - RNA, 19 nt, Artificial Sequence
  Description of Artificial Sequence: Synthetic oligonucleotide
uggugagcgccaucgugcu

SEQ ID NO: 3247 - RNA, 19 nt, Artificial Sequence
  Description of Artificial Sequence: Synthetic oligonucleotide
cuguagcagccgagcauca

SEQ ID NO: 3248 - RNA, 19 nt, Artificial Sequence
  Description of Artificial Sequence: Synthetic oligonucleotide
ugaugcucggcugcuacag

SEQ ID NO: 3249 - RNA, 19 nt, Artificial Sequence
  Description of Artificial Sequence: Synthetic oligonucleotide
agccgagcaucagcccgaa

SEQ ID NO: 3250 - RNA, 19 nt, Artificial Sequence
  Description of Artificial Sequence: Synthetic oligonucleotide
uucgggcugaugcucggcu

SEQ ID NO: 3251 - RNA, 19 nt, Artificial Sequence
  Description of Artificial Sequence: Synthetic oligonucleotide
gucagagucuccaggcuca

SEQ ID NO: 3252 - RNA, 19 nt, Artificial Sequence
  Description of Artificial Sequence: Synthetic oligonucleotide
ugagccuggagacucugac

SEQ ID NO: 3253 - RNA, 19 nt, Artificial Sequence
  Description of Artificial Sequence: Synthetic oligonucleotide
ucagagucuccaggcucag

SEQ ID NO: 3254 - RNA, 19 nt, Artificial Sequence
  Description of Artificial Sequence: Synthetic oligonucleotide
cugagccuggagacucuga

SEQ ID NO: 3255 - RNA, 19 nt, Artificial Sequence
  Description of Artificial Sequence: Synthetic oligonucleotide
cagagucuccaggcucagg

SEQ ID NO: 3256 - RNA, 19 nt, Artificial Sequence
  Description of Artificial Sequence: Synthetic oligonucleotide
ccugagccuggagacucug

SEQ ID NO: 3257 - RNA, 19 nt, Artificial Sequence
  Description of Artificial Sequence: Synthetic oligonucleotide
agagucuccaggcucaggu

SEQ ID NO: 3258 - RNA, 19 nt, Artificial Sequence
  Description of Artificial Sequence: Synthetic oligonucleotide
accugagccuggagacucu

SEQ ID NO: 3259 - RNA, 19 nt, Artificial Sequence
  Description of Artificial Sequence: Synthetic oligonucleotide
gagucuccaggcucaggug

SEQ ID NO: 3260 - RNA, 19 nt, Artificial Sequence
  Description of Artificial Sequence: Synthetic oligonucleotide
caccugagccuggagacuc

SEQ ID NO: 3261 - RNA, 19 nt, Artificial Sequence
  Description of Artificial Sequence: Synthetic oligonucleotide
agucuccaggcucaggugg

SEQ ID NO: 3262 - RNA, 19 nt, Artificial Sequence
  Description of Artificial Sequence: Synthetic oligonucleotide
ccaccugagccuggagacu

SEQ ID NO: 3263 - RNA, 19 nt, Artificial Sequence
  Description of Artificial Sequence: Synthetic oligonucleotide
ggguggcacagcuggcaua

SEQ ID NO: 3264 - RNA, 19 nt, Artificial Sequence
  Description of Artificial Sequence: Synthetic oligonucleotide
uaugccagcugugccaccc

SEQ ID NO: 3265 - RNA, 19 nt, Artificial Sequence
  Description of Artificial Sequence: Synthetic oligonucleotide
guggcacagcuggcauacg

SEQ ID NO: 3266 - RNA, 19 nt, Artificial Sequence
  Description of Artificial Sequence: Synthetic oligonucleotide
cguaugccagcugugccac

SEQ ID NO: 3267 - RNA, 19 nt, Artificial Sequence
  Description of Artificial Sequence: Synthetic oligonucleotide
uggcacagcuggcauacgc

SEQ ID NO: 3268 - RNA, 19 nt, Artificial Sequence
  Description of Artificial Sequence: Synthetic oligonucleotide
gcguaugccagcugugcca

SEQ ID NO: 3269 - RNA, 19 nt, Artificial Sequence
  Description of Artificial Sequence: Synthetic oligonucleotide
cuccacagguggcgguaga

SEQ ID NO: 3270 - RNA, 19 nt, Artificial Sequence
  Description of Artificial Sequence: Synthetic oligonucleotide
ucuaccgccaccuguggag

SEQ ID NO: 3271 - RNA, 19 nt, Artificial Sequence
  Description of Artificial Sequence: Synthetic oligonucleotide
uccacagguggcgguagac

SEQ ID NO: 3272 - RNA, 19 nt, Artificial Sequence
  Description of Artificial Sequence: Synthetic oligonucleotide
gucuaccgccaccugugga

SEQ ID NO: 3273 - RNA, 19 nt, Artificial Sequence
  Description of Artificial Sequence: Synthetic oligonucleotide
ugagcagcacgcuggcgua

SEQ ID NO: 3274 - RNA, 19 nt, Artificial Sequence
  Description of Artificial Sequence: Synthetic oligonucleotide
uacgccagcgugcugcuca

SEQ ID NO: 3275 - RNA, 19 nt, Artificial Sequence
  Description of Artificial Sequence: Synthetic oligonucleotide
agcagcacgcuggcguaca

SEQ ID NO: 3276 - RNA, 19 nt, Artificial Sequence
  Description of Artificial Sequence: Synthetic oligonucleotide
uguacgccagcgugcugcu

SEQ ID NO: 3277 - RNA, 19 nt, Artificial Sequence
  Description of Artificial Sequence: Synthetic oligonucleotide
gcagcacgcuggcguacau

SEQ ID NO: 3278 - RNA, 19 nt, Artificial Sequence
  Description of Artificial Sequence: Synthetic oligonucleotide
auguacgccagcgugcugc

SEQ ID NO: 3279 - RNA, 19 nt, Artificial Sequence
  Description of Artificial Sequence: Synthetic oligonucleotide
cagcacgcuggcguacaug

SEQ ID NO: 3280 - RNA, 19 nt, Artificial Sequence
  Description of Artificial Sequence: Synthetic oligonucleotide
cauguacgccagcgugcug

SEQ ID NO: 3281 - RNA, 19 nt, Artificial Sequence
  Description of Artificial Sequence: Synthetic oligonucleotide
agcacgcuggcguacaugc

SEQ ID NO: 3282 - RNA, 19 nt, Artificial Sequence
  Description of Artificial Sequence: Synthetic oligonucleotide
gcauguacgccagcgugcu

SEQ ID NO: 3283 - RNA, 19 nt, Artificial Sequence
  Description of Artificial Sequence: Synthetic oligonucleotide
gcacgcuggcguacaugcu

SEQ ID NO: 3284 - RNA, 19 nt, Artificial Sequence
  Description of Artificial Sequence: Synthetic oligonucleotide
agcauguacgccagcgugc

SEQ ID NO: 3285 - RNA, 19 nt, Artificial Sequence
  Description of Artificial Sequence: Synthetic oligonucleotide
cacgcuggcguacaugcug

SEQ ID NO: 3286 - RNA, 19 nt, Artificial Sequence
  Description of Artificial Sequence: Synthetic oligonucleotide
cagcauguacgccagcgug

SEQ ID NO: 3287 - RNA, 19 nt, Artificial Sequence
  Description of Artificial Sequence: Synthetic oligonucleotide
acgcuggcguacaugcuga

SEQ ID NO: 3288 - RNA, 19 nt, Artificial Sequence
  Description of Artificial Sequence: Synthetic oligonucleotide
ucagcauguacgccagcgu

SEQ ID NO: 3289 - RNA, 19 nt, Artificial Sequence
  Description of Artificial Sequence: Synthetic oligonucleotide
cuggcguacaugcugagcg

SEQ ID NO: 3290 - RNA, 19 nt, Artificial Sequence
  Description of Artificial Sequence: Synthetic oligonucleotide
cgcucagcauguacgccag

SEQ ID NO: 3291 - RNA, 19 nt, Artificial Sequence
  Description of Artificial Sequence: Synthetic oligonucleotide
uggcguacaugcugagcgc

SEQ ID NO: 3292 - RNA, 19 nt, Artificial Sequence
  Description of Artificial Sequence: Synthetic oligonucleotide
gcgcucagcauguacgcca

SEQ ID NO: 3293 - RNA, 19 nt, Artificial Sequence
  Description of Artificial Sequence: Synthetic oligonucleotide
cgcgcacacguaguacacc

SEQ ID NO: 3294 - RNA, 19 nt, Artificial Sequence
  Description of Artificial Sequence: Synthetic oligonucleotide
gguguacuacgugugcgcg

SEQ ID NO: 3295 - RNA, 19 nt, Artificial Sequence
  Description of Artificial Sequence: Synthetic oligonucleotide
gcgcacacguaguacaccg

SEQ ID NO: 3296 - RNA, 19 nt, Artificial Sequence
  Description of Artificial Sequence: Synthetic oligonucleotide
cgguguacuacgugugcgc

SEQ ID NO: 3297 - RNA, 19 nt, Artificial Sequence
  Description of Artificial Sequence: Synthetic oligonucleotide
cgcacacguaguacaccgc

SEQ ID NO: 3298 - RNA, 19 nt, Artificial Sequence
  Description of Artificial Sequence: Synthetic oligonucleotide
gcgguguacuacgugugcg

SEQ ID NO: 3299 - RNA, 19 nt, Artificial Sequence
  Description of Artificial Sequence: Synthetic oligonucleotide
gcacacguaguacaccgcc

SEQ ID NO: 3300 - RNA, 19 nt, Artificial Sequence
  Description of Artificial Sequence: Synthetic oligonucleotide
ggcgguguacuacgugugc

SEQ ID NO: 3301 - RNA, 19 nt, Artificial Sequence
  Description of Artificial Sequence: Synthetic oligonucleotide
cacacguaguacaccgccu

SEQ ID NO: 3302 - RNA, 19 nt, Artificial Sequence
  Description of Artificial Sequence: Synthetic oligonucleotide
aggcgguguacuacgugug

SEQ ID NO: 3303 - RNA, 19 nt, Artificial Sequence
  Description of Artificial Sequence: Synthetic oligonucleotide
acacguaguacaccgccuu

SEQ ID NO: 3304 - RNA, 19 nt, Artificial Sequence
  Description of Artificial Sequence: Synthetic oligonucleotide
aaggcgguguacuacgugu

SEQ ID NO: 3305 - RNA, 19 nt, Artificial Sequence
  Description of Artificial Sequence: Synthetic oligonucleotide
cacguaguacaccgccuug

SEQ ID NO: 3306 - RNA, 19 nt, Artificial Sequence
  Description of Artificial Sequence: Synthetic oligonucleotide
caaggcgguguacuacgug

SEQ ID NO: 3307 - RNA, 19 nt, Artificial Sequence
  Description of Artificial Sequence: Synthetic oligonucleotide
uaguacaccgccuugcagc

SEQ ID NO: 3308 - RNA, 19 nt, Artificial Sequence
  Description of Artificial Sequence: Synthetic oligonucleotide
gcugcaaggcgguguacua

SEQ ID NO: 3309 - RNA, 19 nt, Artificial Sequence
  Description of Artificial Sequence: Synthetic oligonucleotide
ccaagcuccacaccacgaa

SEQ ID NO: 3310 - RNA, 19 nt, Artificial Sequence
  Description of Artificial Sequence: Synthetic oligonucleotide
uucgugguguggagcuugg

SEQ ID NO: 3311 - RNA, 19 nt, Artificial Sequence
  Description of Artificial Sequence: Synthetic oligonucleotide
caagcuccacaccacgaag

SEQ ID NO: 3312 - RNA, 19 nt, Artificial Sequence
  Description of Artificial Sequence: Synthetic oligonucleotide
cuucgugguguggagcuug

SEQ ID NO: 3313 - RNA, 19 nt, Artificial Sequence
  Description of Artificial Sequence: Synthetic oligonucleotide
aagcuccacaccacgaagc

SEQ ID NO: 3314 - RNA, 19 nt, Artificial Sequence
  Description of Artificial Sequence: Synthetic oligonucleotide
gcuucgugguguggagcuu

SEQ ID NO: 3315 - RNA, 19 nt, Artificial Sequence
  Description of Artificial Sequence: Synthetic oligonucleotide
agcuccacaccacgaagcc

SEQ ID NO: 3316 - RNA, 19 nt, Artificial Sequence
  Description of Artificial Sequence: Synthetic oligonucleotide
ggcuucgugguguggagcu

SEQ ID NO: 3317 - RNA, 19 nt, Artificial Sequence
  Description of Artificial Sequence: Synthetic oligonucleotide
cuccacaccacgaagccgu

SEQ ID NO: 3318 - RNA, 19 nt, Artificial Sequence
  Description of Artificial Sequence: Synthetic oligonucleotide
acggcuucgugguguggag

SEQ ID NO: 3319 - RNA, 19 nt, Artificial Sequence
  Description of Artificial Sequence: Synthetic oligonucleotide
uccacaccacgaagccguu

SEQ ID NO: 3320 - RNA, 19 nt, Artificial Sequence
  Description of Artificial Sequence: Synthetic oligonucleotide
aacggcuucguggugugga

SEQ ID NO: 3321 - RNA, 19 nt, Artificial Sequence
  Description of Artificial Sequence: Synthetic oligonucleotide
ccacaccacgaagccguug

SEQ ID NO: 3322 - RNA, 19 nt, Artificial Sequence
  Description of Artificial Sequence: Synthetic oligonucleotide
caacggcuucguggugugg

SEQ ID NO: 3323 - RNA, 19 nt, Artificial Sequence
  Description of Artificial Sequence: Synthetic oligonucleotide
cacaccacgaagccguugc

SEQ ID NO: 3324 - RNA, 19 nt, Artificial Sequence
  Description of Artificial Sequence: Synthetic oligonucleotide
gcaacggcuucguggugug

SEQ ID NO: 3325 - RNA, 19 nt, Artificial Sequence
  Description of Artificial Sequence: Synthetic oligonucleotide
acaccacgaagccguugcc

SEQ ID NO: 3326 - RNA, 19 nt, Artificial Sequence
  Description of Artificial Sequence: Synthetic oligonucleotide
ggcaacggcuucguggugu

SEQ ID NO: 3327 - RNA, 19 nt, Artificial Sequence
  Description of Artificial Sequence: Synthetic oligonucleotide
caccacgaagccguugcca

SEQ ID NO: 3328 - RNA, 19 nt, Artificial Sequence
  Description of Artificial Sequence: Synthetic oligonucleotide
uggcaacggcuucguggug

SEQ ID NO: 3329 - RNA, 19 nt, Artificial Sequence
  Description of Artificial Sequence: Synthetic oligonucleotide
accacgaagccguugccag

SEQ ID NO: 3330 - RNA, 19 nt, Artificial Sequence
  Description of Artificial Sequence: Synthetic oligonucleotide
cuggcaacggcuucguggu

SEQ ID NO: 3331 - RNA, 19 nt, Artificial Sequence
  Description of Artificial Sequence: Synthetic oligonucleotide
ccgcgaagucuuccagcuc

SEQ ID NO: 3332 - RNA, 19 nt, Artificial Sequence
  Description of Artificial Sequence: Synthetic oligonucleotide
gagcuggaagacuucgcgg

SEQ ID NO: 3333 - RNA, 19 nt, Artificial Sequence
  Description of Artificial Sequence: Synthetic oligonucleotide
cgcgaagucuuccagcuca

SEQ ID NO: 3334 - RNA, 19 nt, Artificial Sequence
  Description of Artificial Sequence: Synthetic oligonucleotide
ugagcuggaagacuucgcg

SEQ ID NO: 3335 - RNA, 19 nt, Artificial Sequence
  Description of Artificial Sequence: Synthetic oligonucleotide
gcgaagucuuccagcucag

SEQ ID NO: 3336 - RNA, 19 nt, Artificial Sequence
  Description of Artificial Sequence: Synthetic oligonucleotide
cugagcuggaagacuucgc

SEQ ID NO: 3337 - RNA, 19 nt, Artificial Sequence
  Description of Artificial Sequence: Synthetic oligonucleotide
uuccagcucagcagugucu

SEQ ID NO: 3338 - RNA, 19 nt, Artificial Sequence
  Description of Artificial Sequence: Synthetic oligonucleotide
agacacugcugagcuggaa

SEQ ID NO: 3339 - RNA, 19 nt, Artificial Sequence
  Description of Artificial Sequence: Synthetic oligonucleotide
uccagcucagcagugucuc

SEQ ID NO: 3340 - RNA, 19 nt, Artificial Sequence
  Description of Artificial Sequence: Synthetic oligonucleotide
gagacacugcugagcugga

SEQ ID NO: 3341 - RNA, 19 nt, Artificial Sequence
  Description of Artificial Sequence: Synthetic oligonucleotide
ccagcucagcagugucucg

SEQ ID NO: 3342 - RNA, 19 nt, Artificial Sequence
  Description of Artificial Sequence: Synthetic oligonucleotide
cgagacacugcugagcugg

SEQ ID NO: 3343 - RNA, 19 nt, Artificial Sequence
  Description of Artificial Sequence: Synthetic oligonucleotide
cagcucagcagugucucgu

SEQ ID NO: 3344 - RNA, 19 nt, Artificial Sequence
  Description of Artificial Sequence: Synthetic oligonucleotide
acgagacacugcugagcug

SEQ ID NO: 3345 - RNA, 19 nt, Artificial Sequence
  Description of Artificial Sequence: Synthetic oligonucleotide
agcucagcagugucucguu

SEQ ID NO: 3346 - RNA, 19 nt, Artificial Sequence
  Description of Artificial Sequence: Synthetic oligonucleotide
aacgagacacugcugagcu

SEQ ID NO: 3347 - RNA, 19 nt, Artificial Sequence
  Description of Artificial Sequence: Synthetic oligonucleotide
gcucagcagugucucguuc

SEQ ID NO: 3348 - RNA, 19 nt, Artificial Sequence
  Description of Artificial Sequence: Synthetic oligonucleotide
gaacgagacacugcugagc

SEQ ID NO: 3349 - RNA, 19 nt, Artificial Sequence
  Description of Artificial Sequence: Synthetic oligonucleotide
cucagcagugucucguucc

SEQ ID NO: 3350 - RNA, 19 nt, Artificial Sequence
  Description of Artificial Sequence: Synthetic oligonucleotide
ggaacgagacacugcugag

SEQ ID NO: 3351 - RNA, 19 nt, Artificial Sequence
  Description of Artificial Sequence: Synthetic oligonucleotide
guagcagaccgacauccuu

SEQ ID NO: 3352 - RNA, 19 nt, Artificial Sequence
  Description of Artificial Sequence: Synthetic oligonucleotide
aaggaugucggucugcuac

SEQ ID NO: 3353 - RNA, 19 nt, Artificial Sequence
  Description of Artificial Sequence: Synthetic oligonucleotide
uagcagaccgacauccuuc

SEQ ID NO: 3354 - RNA, 19 nt, Artificial Sequence
  Description of Artificial Sequence: Synthetic oligonucleotide
gaaggaugucggucugcua

SEQ ID NO: 3355 - RNA, 19 nt, Artificial Sequence
  Description of Artificial Sequence: Synthetic oligonucleotide
agcagaccgacauccuucu

SEQ ID NO: 3356 - RNA, 19 nt, Artificial Sequence
  Description of Artificial Sequence: Synthetic oligonucleotide
agaaggaugucggucugcu

SEQ ID NO: 3357 - RNA, 19 nt, Artificial Sequence
  Description of Artificial Sequence: Synthetic oligonucleotide
agaccgacauccuucuggg

SEQ ID NO: 3358 - RNA, 19 nt, Artificial Sequence
  Description of Artificial Sequence: Synthetic oligonucleotide
cccagaaggaugucggucu

SEQ ID NO: 3359 - RNA, 19 nt, Artificial Sequence
  Description of Artificial Sequence: Synthetic oligonucleotide
gaccgacauccuucugggc

SEQ ID NO: 3360 - RNA, 19 nt, Artificial Sequence
  Description of Artificial Sequence: Synthetic oligonucleotide
gcccagaaggaugucgguc

SEQ ID NO: 3361 - RNA, 19 nt, Artificial Sequence
  Description of Artificial Sequence: Synthetic oligonucleotide
ccgacauccuucugggccu

SEQ ID NO: 3362 - RNA, 19 nt, Artificial Sequence
  Description of Artificial Sequence: Synthetic oligonucleotide
aggcccagaaggaugucgg

SEQ ID NO: 3363 - RNA, 19 nt, Artificial Sequence
  Description of Artificial Sequence: Synthetic oligonucleotide
cgacauccuucugggccua

SEQ ID NO: 3364 - RNA, 19 nt, Artificial Sequence
  Description of Artificial Sequence: Synthetic oligonucleotide
uaggcccagaaggaugucg

SEQ ID NO: 3365 - RNA, 19 nt, Artificial Sequence
  Description of Artificial Sequence: Synthetic oligonucleotide
gacauccuucugggccuac

SEQ ID NO: 3366 - RNA, 19 nt, Artificial Sequence
  Description of Artificial Sequence: Synthetic oligonucleotide
guaggcccagaaggauguc

SEQ ID NO: 3367 - RNA, 19 nt, Artificial Sequence
  Description of Artificial Sequence: Synthetic oligonucleotide
cuucugggccuacaggugg

SEQ ID NO: 3368 - RNA, 19 nt, Artificial Sequence
  Description of Artificial Sequence: Synthetic oligonucleotide
ccaccuguaggcccagaag

SEQ ID NO: 3369 - RNA, 19 nt, Artificial Sequence
  Description of Artificial Sequence: Synthetic oligonucleotide
uucugggccuacagguggg

SEQ ID NO: 3370 - RNA, 19 nt, Artificial Sequence
  Description of Artificial Sequence: Synthetic oligonucleotide
cccaccuguaggcccagaa

SEQ ID NO: 3371 - RNA, 19 nt, Artificial Sequence
  Description of Artificial Sequence: Synthetic oligonucleotide
ucugggccuacaggugggu

SEQ ID NO: 3372 - RNA, 19 nt, Artificial Sequence
  Description of Artificial Sequence: Synthetic oligonucleotide
acccaccuguaggcccaga

SEQ ID NO: 3373 - RNA, 19 nt, Artificial Sequence
  Description of Artificial Sequence: Synthetic oligonucleotide
ggccuacagguggguggaa

SEQ ID NO: 3374 - RNA, 19 nt, Artificial Sequence
  Description of Artificial Sequence: Synthetic oligonucleotide
uuccacccaccuguaggcc

SEQ ID NO: 3375 - RNA, 19 nt, Artificial Sequence
  Description of Artificial Sequence: Synthetic oligonucleotide
ccuacagguggguggaagg

SEQ ID NO: 3376 - RNA, 19 nt, Artificial Sequence
  Description of Artificial Sequence: Synthetic oligonucleotide
ccuuccacccaccuguagg

SEQ ID NO: 3377 - RNA, 19 nt, Artificial Sequence
  Description of Artificial Sequence: Synthetic oligonucleotide
cuacagguggguggaaggc

SEQ ID NO: 3378 - RNA, 19 nt, Artificial Sequence
  Description of Artificial Sequence: Synthetic oligonucleotide
gccuuccacccaccuguag

SEQ ID NO: 3379 - RNA, 19 nt, Artificial Sequence
  Description of Artificial Sequence: Synthetic oligonucleotide
uacagguggguggaaggcg

SEQ ID NO: 3380 - RNA, 19 nt, Artificial Sequence
  Description of Artificial Sequence: Synthetic oligonucleotide
cgccuuccacccaccugua

SEQ ID NO: 3381 - RNA, 19 nt, Artificial Sequence
  Description of Artificial Sequence: Synthetic oligonucleotide
acuucccugcagccugccu

SEQ ID NO: 3382 - RNA, 19 nt, Artificial Sequence
  Description of Artificial Sequence: Synthetic oligonucleotide
aggcaggcugcagggaagu

SEQ ID NO: 3383 - RNA, 19 nt, Artificial Sequence
  Description of Artificial Sequence: Synthetic oligonucleotide
ccugcagccugccucuuuu

SEQ ID NO: 3384 - RNA, 19 nt, Artificial Sequence
  Description of Artificial Sequence: Synthetic oligonucleotide
aaaagaggcaggcugcagg

SEQ ID NO: 3385 - RNA, 19 nt, Artificial Sequence
  Description of Artificial Sequence: Synthetic oligonucleotide
cugcagccugccucuuuuc

SEQ ID NO: 3386 - RNA, 19 nt, Artificial Sequence
  Description of Artificial Sequence: Synthetic oligonucleotide
gaaaagaggcaggcugcag

SEQ ID NO: 3387 - RNA, 19 nt, Artificial Sequence
  Description of Artificial Sequence: Synthetic oligonucleotide
gcagccugccucuuuucug

SEQ ID NO: 3388 - RNA, 19 nt, Artificial Sequence
  Description of Artificial Sequence: Synthetic oligonucleotide
cagaaaagaggcaggcugc

SEQ ID NO: 3389 - RNA, 19 nt, Artificial Sequence
  Description of Artificial Sequence: Synthetic oligonucleotide
cagccugccucuuuucugc

SEQ ID NO: 3390 - RNA, 19 nt, Artificial Sequence
  Description of Artificial Sequence: Synthetic oligonucleotide
gcagaaaagaggcaggcug

SEQ ID NO: 3391 - RNA, 19 nt, Artificial Sequence
  Description of Artificial Sequence: Synthetic oligonucleotide
agccugccucuuuucugcc

SEQ ID NO: 3392 - RNA, 19 nt, Artificial Sequence
  Description of Artificial Sequence: Synthetic oligonucleotide
ggcagaaaagaggcaggcu

SEQ ID NO: 3393 - RNA, 19 nt, Artificial Sequence
  Description of Artificial Sequence: Synthetic oligonucleotide
gccucuuuucugccuggga

SEQ ID NO: 3394 - RNA, 19 nt, Artificial Sequence
  Description of Artificial Sequence: Synthetic oligonucleotide
ucccaggcagaaaagaggc

SEQ ID NO: 3395 - RNA, 19 nt, Artificial Sequence
  Description of Artificial Sequence: Synthetic oligonucleotide
cuuuucugccugggagucc

SEQ ID NO: 3396 - RNA, 19 nt, Artificial Sequence
  Description of Artificial Sequence: Synthetic oligonucleotide
ggacucccaggcagaaaag

SEQ ID NO: 3397 - RNA, 19 nt, Artificial Sequence
  Description of Artificial Sequence: Synthetic oligonucleotide
uuuucugccugggaguccu

SEQ ID NO: 3398 - RNA, 19 nt, Artificial Sequence
  Description of Artificial Sequence: Synthetic oligonucleotide
aggacucccaggcagaaaa

SEQ ID NO: 3399 - RNA, 19 nt, Artificial Sequence
  Description of Artificial Sequence: Synthetic oligonucleotide
uucugccugggaguccuga

SEQ ID NO: 3400 - RNA, 19 nt, Artificial Sequence
  Description of Artificial Sequence: Synthetic oligonucleotide
ucaggacucccaggcagaa

SEQ ID NO: 3401 - RNA, 19 nt, Artificial Sequence
  Description of Artificial Sequence: Synthetic oligonucleotide
ucugccugggaguccugac

SEQ ID NO: 3402 - RNA, 19 nt, Artificial Sequence
  Description of Artificial Sequence: Synthetic oligonucleotide
gucaggacucccaggcaga

SEQ ID NO: 3403 - RNA, 19 nt, Artificial Sequence
  Description of Artificial Sequence: Synthetic oligonucleotide
ugccugggaguccugacuu

SEQ ID NO: 3404 - RNA, 19 nt, Artificial Sequence
  Description of Artificial Sequence: Synthetic oligonucleotide
aagucaggacucccaggca

SEQ ID NO: 3405 - RNA, 19 nt, Artificial Sequence
  Description of Artificial Sequence: Synthetic oligonucleotide
gccugggaguccugacuuc

SEQ ID NO: 3406 - RNA, 19 nt, Artificial Sequence
  Description of Artificial Sequence: Synthetic oligonucleotide
gaagucaggacucccaggc

SEQ ID NO: 3407 - RNA, 19 nt, Artificial Sequence
  Description of Artificial Sequence: Synthetic oligonucleotide
cugggaguccugacuucca

SEQ ID NO: 3408 - RNA, 19 nt, Artificial Sequence
  Description of Artificial Sequence: Synthetic oligonucleotide
uggaagucaggacucccag

SEQ ID NO: 3409 - RNA, 19 nt, Artificial Sequence
  Description of Artificial Sequence: Synthetic oligonucleotide
ugggaguccugacuuccac

SEQ ID NO: 3410 - RNA, 19 nt, Artificial Sequence
  Description of Artificial Sequence: Synthetic oligonucleotide
guggaagucaggacuccca

SEQ ID NO: 3411 - RNA, 19 nt, Artificial Sequence
  Description of Artificial Sequence: Synthetic oligonucleotide
gggaguccugacuuccacg

SEQ ID NO: 3412 - RNA, 19 nt, Artificial Sequence
  Description of Artificial Sequence: Synthetic oligonucleotide
cguggaagucaggacuccc

SEQ ID NO: 3413 - RNA, 19 nt, Artificial Sequence
  Description of Artificial Sequence: Synthetic oligonucleotide
ggaguccugacuuccacga

SEQ ID NO: 3414 - RNA, 19 nt, Artificial Sequence
  Description of Artificial Sequence: Synthetic oligonucleotide
ucguggaagucaggacucc

SEQ ID NO: 3415 - RNA, 19 nt, Artificial Sequence
  Description of Artificial Sequence: Synthetic oligonucleotide
gaguccugacuuccacgag

SEQ ID NO: 3416 - RNA, 19 nt, Artificial Sequence
  Description of Artificial Sequence: Synthetic oligonucleotide
cucguggaagucaggacuc

SEQ ID NO: 3417 - RNA, 19 nt, Artificial Sequence
  Description of Artificial Sequence: Synthetic oligonucleotide
aguccugacuuccacgagg

SEQ ID NO: 3418 - RNA, 19 nt, Artificial Sequence
  Description of Artificial Sequence: Synthetic oligonucleotide
ccucguggaagucaggacu

SEQ ID NO: 3419 - RNA, 19 nt, Artificial Sequence
  Description of Artificial Sequence: Synthetic oligonucleotide
ccugacuuccacgaggacc

SEQ ID NO: 3420 - RNA, 19 nt, Artificial Sequence
  Description of Artificial Sequence: Synthetic oligonucleotide
gguccucguggaagucagg

SEQ ID NO: 3421 - RNA, 19 nt, Artificial Sequence
  Description of Artificial Sequence: Synthetic oligonucleotide
cugacuuccacgaggaccc

SEQ ID NO: 3422 - RNA, 19 nt, Artificial Sequence
  Description of Artificial Sequence: Synthetic oligonucleotide
ggguccucguggaagucag

SEQ ID NO: 3423 - RNA, 19 nt, Artificial Sequence
  Description of Artificial Sequence: Synthetic oligonucleotide
ugacuuccacgaggaccca

SEQ ID NO: 3424 - RNA, 19 nt, Artificial Sequence
  Description of Artificial Sequence: Synthetic oligonucleotide
uggguccucguggaaguca

SEQ ID NO: 3425 - RNA, 19 nt, Artificial Sequence
  Description of Artificial Sequence: Synthetic oligonucleotide
gacuuccacgaggacccag

SEQ ID NO: 3426 - RNA, 19 nt, Artificial Sequence
  Description of Artificial Sequence: Synthetic oligonucleotide
cuggguccucguggaaguc

SEQ ID NO: 3427 - RNA, 19 nt, Artificial Sequence
  Description of Artificial Sequence: Synthetic oligonucleotide
acuuccacgaggacccaga

SEQ ID NO: 3428 - RNA, 19 nt, Artificial Sequence
  Description of Artificial Sequence: Synthetic oligonucleotide
ucuggguccucguggaagu

SEQ ID NO: 3429 - RNA, 19 nt, Artificial Sequence
  Description of Artificial Sequence: Synthetic oligonucleotide
cuuccacgaggacccagac

SEQ ID NO: 3430 - RNA, 19 nt, Artificial Sequence
  Description of Artificial Sequence: Synthetic oligonucleotide
gucuggguccucguggaag

SEQ ID NO: 3431 - RNA, 19 nt, Artificial Sequence
  Description of Artificial Sequence: Synthetic oligonucleotide
uuccacgaggacccagacc

SEQ ID NO: 3432 - RNA, 19 nt, Artificial Sequence
  Description of Artificial Sequence: Synthetic oligonucleotide
ggucuggguccucguggaa

SEQ ID NO: 3433 - RNA, 19 nt, Artificial Sequence
  Description of Artificial Sequence: Synthetic oligonucleotide
cccugcucccagucaguug

SEQ ID NO: 3434 - RNA, 19 nt, Artificial Sequence
  Description of Artificial Sequence: Synthetic oligonucleotide
caacugacugggagcaggg

SEQ ID NO: 3435 - RNA, 19 nt, Artificial Sequence
  Description of Artificial Sequence: Synthetic oligonucleotide
ccugcucccagucaguuga

SEQ ID NO: 3436 - RNA, 19 nt, Artificial Sequence
  Description of Artificial Sequence: Synthetic oligonucleotide
ucaacugacugggagcagg

SEQ ID NO: 3437 - RNA, 19 nt, Artificial Sequence
  Description of Artificial Sequence: Synthetic oligonucleotide
cugcucccagucaguugac

SEQ ID NO: 3438 - RNA, 19 nt, Artificial Sequence
  Description of Artificial Sequence: Synthetic oligonucleotide
gucaacugacugggagcag

SEQ ID NO: 3439 - RNA, 19 nt, Artificial Sequence
  Description of Artificial Sequence: Synthetic oligonucleotide
ugcucccagucaguugacc

SEQ ID NO: 3440 - RNA, 19 nt, Artificial Sequence
  Description of Artificial Sequence: Synthetic oligonucleotide
ggucaacugacugggagca

SEQ ID NO: 3441 - RNA, 19 nt, Artificial Sequence
  Description of Artificial Sequence: Synthetic oligonucleotide
cccagucaguugaccugcc

SEQ ID NO: 3442 - RNA, 19 nt, Artificial Sequence
  Description of Artificial Sequence: Synthetic oligonucleotide
ggcaggucaacugacuggg

SEQ ID NO: 3443 - RNA, 19 nt, Artificial Sequence
  Description of Artificial Sequence: Synthetic oligonucleotide
ccagucaguugaccugccc

SEQ ID NO: 3444 - RNA, 19 nt, Artificial Sequence
  Description of Artificial Sequence: Synthetic oligonucleotide
gggcaggucaacugacugg

SEQ ID NO: 3445 - RNA, 19 nt, Artificial Sequence
  Description of Artificial Sequence: Synthetic oligonucleotide
gccuccuucccagagcuca

SEQ ID NO: 3446 - RNA, 19 nt, Artificial Sequence
  Description of Artificial Sequence: Synthetic oligonucleotide
ugagcucugggaaggaggc

SEQ ID NO: 3447 - RNA, 19 nt, Artificial Sequence
  Description of Artificial Sequence: Synthetic oligonucleotide
ccuccuucccagagcucag

SEQ ID NO: 3448 - RNA, 19 nt, Artificial Sequence
  Description of Artificial Sequence: Synthetic oligonucleotide
cugagcucugggaaggagg

SEQ ID NO: 3449 - RNA, 19 nt, Artificial Sequence
  Description of Artificial Sequence: Synthetic oligonucleotide
cuccuucccagagcucagu

SEQ ID NO: 3450 - RNA, 19 nt, Artificial Sequence
  Description of Artificial Sequence: Synthetic oligonucleotide
acugagcucugggaaggag

SEQ ID NO: 3451 - RNA, 19 nt, Artificial Sequence
  Description of Artificial Sequence: Synthetic oligonucleotide
uccuucccagagcucagug

SEQ ID NO: 3452 - RNA, 19 nt, Artificial Sequence
  Description of Artificial Sequence: Synthetic oligonucleotide
cacugagcucugggaagga

SEQ ID NO: 3453 - RNA, 19 nt, Artificial Sequence
  Description of Artificial Sequence: Synthetic oligonucleotide
ccuucccagagcucagugg

SEQ ID NO: 3454 - RNA, 19 nt, Artificial Sequence
  Description of Artificial Sequence: Synthetic oligonucleotide
ccacugagcucugggaagg

SEQ ID NO: 3455 - RNA, 19 nt, Artificial Sequence
  Description of Artificial Sequence: Synthetic oligonucleotide
uucccagagcucaguggua

SEQ ID NO: 3456 - RNA, 19 nt, Artificial Sequence
  Description of Artificial Sequence: Synthetic oligonucleotide
uaccacugagcucugggaa

SEQ ID NO: 3457 - RNA, 19 nt, Artificial Sequence
  Description of Artificial Sequence: Synthetic oligonucleotide
ucccagagcucagugguaa

SEQ ID NO: 3458 - RNA, 19 nt, Artificial Sequence
  Description of Artificial Sequence: Synthetic oligonucleotide
uuaccacugagcucuggga

SEQ ID NO: 3459 - RNA, 19 nt, Artificial Sequence
  Description of Artificial Sequence: Synthetic oligonucleotide
caggcugucacuaucucua

SEQ ID NO: 3460 - RNA, 19 nt, Artificial Sequence
  Description of Artificial Sequence: Synthetic oligonucleotide
uagagauagugacagccug

SEQ ID NO: 3461 - RNA, 19 nt, Artificial Sequence
  Description of Artificial Sequence: Synthetic oligonucleotide
aggcugucacuaucucuac

SEQ ID NO: 3462 - RNA, 19 nt, Artificial Sequence
  Description of Artificial Sequence: Synthetic oligonucleotide
guagagauagugacagccu

SEQ ID NO: 3463 - RNA, 19 nt, Artificial Sequence
  Description of Artificial Sequence: Synthetic oligonucleotide
ucucuaccaccacuccucu

SEQ ID NO: 3464 - RNA, 19 nt, Artificial Sequence
  Description of Artificial Sequence: Synthetic oligonucleotide
agaggaguggugguagaga

SEQ ID NO: 3465 - RNA, 19 nt, Artificial Sequence
  Description of Artificial Sequence: Synthetic oligonucleotide
ccaccacuccucuagucug

SEQ ID NO: 3466 - RNA, 19 nt, Artificial Sequence
  Description of Artificial Sequence: Synthetic oligonucleotide
cagacuagaggaguggugg

SEQ ID NO: 3467 - RNA, 19 nt, Artificial Sequence
  Description of Artificial Sequence: Synthetic oligonucleotide
caccacuccucuagucugg

SEQ ID NO: 3468 - RNA, 19 nt, Artificial Sequence
  Description of Artificial Sequence: Synthetic oligonucleotide
ccagacuagaggaguggug

SEQ ID NO: 3469 - RNA, 19 nt, Artificial Sequence
  Description of Artificial Sequence: Synthetic oligonucleotide
accacuccucuagucuggc

SEQ ID NO: 3470 - RNA, 19 nt, Artificial Sequence
  Description of Artificial Sequence: Synthetic oligonucleotide
gccagacuagaggaguggu

SEQ ID NO: 3471 - RNA, 19 nt, Artificial Sequence
  Description of Artificial Sequence: Synthetic oligonucleotide
ccacuccucuagucuggcc

SEQ ID NO: 3472 - RNA, 19 nt, Artificial Sequence
  Description of Artificial Sequence: Synthetic oligonucleotide
ggccagacuagaggagugg

SEQ ID NO: 3473 - RNA, 19 nt, Artificial Sequence
  Description of Artificial Sequence: Synthetic oligonucleotide
cacuccucuagucuggccc

SEQ ID NO: 3474 - RNA, 19 nt, Artificial Sequence
  Description of Artificial Sequence: Synthetic oligonucleotide
gggccagacuagaggagug

SEQ ID NO: 3475 - RNA, 19 nt, Artificial Sequence
  Description of Artificial Sequence: Synthetic oligonucleotide
auucuagcacaucugggca

SEQ ID NO: 3476 - RNA, 19 nt, Artificial Sequence
  Description of Artificial Sequence: Synthetic oligonucleotide
ugcccagaugugcuagaau

SEQ ID NO: 3477 - RNA, 19 nt, Artificial Sequence
  Description of Artificial Sequence: Synthetic oligonucleotide
uucuagcacaucugggcaa

SEQ ID NO: 3478 - RNA, 19 nt, Artificial Sequence
  Description of Artificial Sequence: Synthetic oligonucleotide
uugcccagaugugcuagaa

SEQ ID NO: 3479 - RNA, 19 nt, Artificial Sequence
  Description of Artificial Sequence: Synthetic oligonucleotide
ucuagcacaucugggcaaa

SEQ ID NO: 3480 - RNA, 19 nt, Artificial Sequence
  Description of Artificial Sequence: Synthetic oligonucleotide
uuugcccagaugugcuaga

SEQ ID NO: 3481 - RNA, 19 nt, Artificial Sequence
  Description of Artificial Sequence: Synthetic oligonucleotide
cuagcacaucugggcaaaa

SEQ ID NO: 3482 - RNA, 19 nt, Artificial Sequence
  Description of Artificial Sequence: Synthetic oligonucleotide
uuuugcccagaugugcuag

SEQ ID NO: 3483 - RNA, 19 nt, Artificial Sequence
  Description of Artificial Sequence: Synthetic oligonucleotide
ggguguaaagggacgugca

SEQ ID NO: 3484 - RNA, 19 nt, Artificial Sequence
  Description of Artificial Sequence: Synthetic oligonucleotide
ugcacgucccuuuacaccc

SEQ ID NO: 3485 - RNA, 19 nt, Artificial Sequence
  Description of Artificial Sequence: Synthetic oligonucleotide
gguguaaagggacgugcac

SEQ ID NO: 3486 - RNA, 19 nt, Artificial Sequence
  Description of Artificial Sequence: Synthetic oligonucleotide
gugcacgucccuuuacacc

SEQ ID NO: 3487 - RNA, 19 nt, Artificial Sequence
  Description of Artificial Sequence: Synthetic oligonucleotide
guguaaagggacgugcaca

SEQ ID NO: 3488 - RNA, 19 nt, Artificial Sequence
  Description of Artificial Sequence: Synthetic oligonucleotide
ugugcacgucccuuuacac

SEQ ID NO: 3489 - RNA, 19 nt, Artificial Sequence
  Description of Artificial Sequence: Synthetic oligonucleotide
uguaaagggacgugcacag

SEQ ID NO: 3490 - RNA, 19 nt, Artificial Sequence
  Description of Artificial Sequence: Synthetic oligonucleotide
cugugcacgucccuuuaca

SEQ ID NO: 3491 - RNA, 19 nt, Artificial Sequence
  Description of Artificial Sequence: Synthetic oligonucleotide
guaaagggacgugcacaga

SEQ ID NO: 3492 - RNA, 19 nt, Artificial Sequence
  Description of Artificial Sequence: Synthetic oligonucleotide
ucugugcacgucccuuuac

SEQ ID NO: 3493 - RNA, 19 nt, Artificial Sequence
  Description of Artificial Sequence: Synthetic oligonucleotide
uaaagggacgugcacagau

SEQ ID NO: 3494 - RNA, 19 nt, Artificial Sequence
  Description of Artificial Sequence: Synthetic oligonucleotide
aucugugcacgucccuuua

SEQ ID NO: 3495 - RNA, 19 nt, Artificial Sequence
  Description of Artificial Sequence: Synthetic oligonucleotide
aaagggacgugcacagauc

SEQ ID NO: 3496 - RNA, 19 nt, Artificial Sequence
  Description of Artificial Sequence: Synthetic oligonucleotide
gaucugugcacgucccuuu

SEQ ID NO: 3497 - RNA, 19 nt, Artificial Sequence
  Description of Artificial Sequence: Synthetic oligonucleotide
aagggacgugcacagaucu

SEQ ID NO: 3498 - RNA, 19 nt, Artificial Sequence
  Description of Artificial Sequence: Synthetic oligonucleotide
agaucugugcacgucccuu

SEQ ID NO: 3499 - RNA, 19 nt, Artificial Sequence
  Description of Artificial Sequence: Synthetic oligonucleotide
agggacgugcacagaucua

SEQ ID NO: 3500 - RNA, 19 nt, Artificial Sequence
  Description of Artificial Sequence: Synthetic oligonucleotide
uagaucugugcacgucccu

SEQ ID NO: 3501 - RNA, 19 nt, Artificial Sequence
  Description of Artificial Sequence: Synthetic oligonucleotide
cgugcacagaucuacuuac

SEQ ID NO: 3502 - RNA, 19 nt, Artificial Sequence
  Description of Artificial Sequence: Synthetic oligonucleotide
guaaguagaucugugcacg

SEQ ID NO: 3503 - RNA, 19 nt, Artificial Sequence
  Description of Artificial Sequence: Synthetic oligonucleotide
gugcacagaucuacuuacc

SEQ ID NO: 3504 - RNA, 19 nt, Artificial Sequence
  Description of Artificial Sequence: Synthetic oligonucleotide
gguaaguagaucugugcac

SEQ ID NO: 3505 - RNA, 19 nt, Artificial Sequence
  Description of Artificial Sequence: Synthetic oligonucleotide
ugcacagaucuacuuacca

SEQ ID NO: 3506 - RNA, 19 nt, Artificial Sequence
  Description of Artificial Sequence: Synthetic oligonucleotide
ugguaaguagaucugugca

SEQ ID NO: 3507 - RNA, 19 nt, Artificial Sequence
  Description of Artificial Sequence: Synthetic oligonucleotide
gcacagaucuacuuaccaa

SEQ ID NO: 3508 - RNA, 19 nt, Artificial Sequence
  Description of Artificial Sequence: Synthetic oligonucleotide
uugguaaguagaucugugc

SEQ ID NO: 3509 - RNA, 19 nt, Artificial Sequence
  Description of Artificial Sequence: Synthetic oligonucleotide
cacagaucuacuuaccaag

SEQ ID NO: 3510 - RNA, 19 nt, Artificial Sequence
  Description of Artificial Sequence: Synthetic oligonucleotide
cuugguaaguagaucugug

SEQ ID NO: 3511 - RNA, 19 nt, Artificial Sequence
  Description of Artificial Sequence: Synthetic oligonucleotide
acagaucuacuuaccaagc

SEQ ID NO: 3512 - RNA, 19 nt, Artificial Sequence
  Description of Artificial Sequence: Synthetic oligonucleotide
gcuugguaaguagaucugu

SEQ ID NO: 3513 - RNA, 19 nt, Artificial Sequence
  Description of Artificial Sequence: Synthetic oligonucleotide
cagaucuacuuaccaagcu

SEQ ID NO: 3514 - RNA, 19 nt, Artificial Sequence
  Description of Artificial Sequence: Synthetic oligonucleotide
agcuugguaaguagaucug

SEQ ID NO: 3515 - RNA, 19 nt, Artificial Sequence
  Description of Artificial Sequence: Synthetic oligonucleotide
agaucuacuuaccaagcug

SEQ ID NO: 3516 - RNA, 19 nt, Artificial Sequence
  Description of Artificial Sequence: Synthetic oligonucleotide
cagcuugguaaguagaucu

SEQ ID NO: 3517 - RNA, 19 nt, Artificial Sequence
  Description of Artificial Sequence: Synthetic oligonucleotide
aucuacuuaccaagcuggg

SEQ ID NO: 3518 - RNA, 19 nt, Artificial Sequence
  Description of Artificial Sequence: Synthetic oligonucleotide
cccagcuugguaaguagau

SEQ ID NO: 3519 - RNA, 19 nt, Artificial Sequence
  Description of Artificial Sequence: Synthetic oligonucleotide
ucuacuuaccaagcuggga

SEQ ID NO: 3520 - RNA, 19 nt, Artificial Sequence
  Description of Artificial Sequence: Synthetic oligonucleotide
ucccagcuugguaaguaga

SEQ ID NO: 3521 - RNA, 19 nt, Artificial Sequence
  Description of Artificial Sequence: Synthetic oligonucleotide
cuuaccaagcugggagcaa

SEQ ID NO: 3522 - RNA, 19 nt, Artificial Sequence
  Description of Artificial Sequence: Synthetic oligonucleotide
uugcucccagcuugguaag

SEQ ID NO: 3523 - RNA, 19 nt, Artificial Sequence
  Description of Artificial Sequence: Synthetic oligonucleotide
uuaccaagcugggagcaag

SEQ ID NO: 3524 - RNA, 19 nt, Artificial Sequence
  Description of Artificial Sequence: Synthetic oligonucleotide
cuugcucccagcuugguaa

SEQ ID NO: 3525 - RNA, 19 nt, Artificial Sequence
  Description of Artificial Sequence: Synthetic oligonucleotide
uaccaagcugggagcaagc

SEQ ID NO: 3526 - RNA, 19 nt, Artificial Sequence
  Description of Artificial Sequence: Synthetic oligonucleotide
gcuugcucccagcuuggua

SEQ ID NO: 3527 - RNA, 19 nt, Artificial Sequence
  Description of Artificial Sequence: Synthetic oligonucleotide
accaagcugggagcaagca

SEQ ID NO: 3528 - RNA, 19 nt, Artificial Sequence
  Description of Artificial Sequence: Synthetic oligonucleotide
ugcuugcucccagcuuggu

SEQ ID NO: 3529 - RNA, 19 nt, Artificial Sequence
  Description of Artificial Sequence: Synthetic oligonucleotide
gcugggagcaagcaggauu

SEQ ID NO: 3530 - RNA, 19 nt, Artificial Sequence
  Description of Artificial Sequence: Synthetic oligonucleotide
aauccugcuugcucccagc

SEQ ID NO: 3531 - RNA, 19 nt, Artificial Sequence
  Description of Artificial Sequence: Synthetic oligonucleotide
cugggagcaagcaggauug

SEQ ID NO: 3532 - RNA, 19 nt, Artificial Sequence
  Description of Artificial Sequence: Synthetic oligonucleotide
caauccugcuugcucccag

SEQ ID NO: 3533 - RNA, 19 nt, Artificial Sequence
  Description of Artificial Sequence: Synthetic oligonucleotide
ugggagcaagcaggauugg

SEQ ID NO: 3534 - RNA, 19 nt, Artificial Sequence
  Description of Artificial Sequence: Synthetic oligonucleotide
ccaauccugcuugcuccca

SEQ ID NO: 3535 - RNA, 19 nt, Artificial Sequence
  Description of Artificial Sequence: Synthetic oligonucleotide
gggagcaagcaggauuggg

SEQ ID NO: 3536 - RNA, 19 nt, Artificial Sequence
  Description of Artificial Sequence: Synthetic oligonucleotide
cccaauccugcuugcuccc

SEQ ID NO: 3537 - RNA, 19 nt, Artificial Sequence
  Description of Artificial Sequence: Synthetic oligonucleotide
aaagguuaagcagcaguag

SEQ ID NO: 3538 - RNA, 19 nt, Artificial Sequence
  Description of Artificial Sequence: Synthetic oligonucleotide
cuacugcugcuuaaccuuu

SEQ ID NO: 3539 - RNA, 19 nt, Artificial Sequence
  Description of Artificial Sequence: Synthetic oligonucleotide
aagguuaagcagcaguagg

SEQ ID NO: 3540 - RNA, 19 nt, Artificial Sequence
  Description of Artificial Sequence: Synthetic oligonucleotide
ccuacugcugcuuaaccuu

SEQ ID NO: 3541 - RNA, 19 nt, Artificial Sequence
  Description of Artificial Sequence: Synthetic oligonucleotide
agguuaagcagcaguaggc

SEQ ID NO: 3542 - RNA, 19 nt, Artificial Sequence
  Description of Artificial Sequence: Synthetic oligonucleotide
gccuacugcugcuuaaccu

SEQ ID NO: 3543 - RNA, 19 nt, Artificial Sequence
  Description of Artificial Sequence: Synthetic oligonucleotide
ggugccuacuccuguccug

SEQ ID NO: 3544 - RNA, 19 nt, Artificial Sequence
  Description of Artificial Sequence: Synthetic oligonucleotide
caggacaggaguaggcacc

SEQ ID NO: 3545 - RNA, 19 nt, Artificial Sequence
  Description of Artificial Sequence: Synthetic oligonucleotide
gugccuacuccuguccugu

SEQ ID NO: 3546 - RNA, 19 nt, Artificial Sequence
  Description of Artificial Sequence: Synthetic oligonucleotide
acaggacaggaguaggcac

SEQ ID NO: 3547 - RNA, 19 nt, Artificial Sequence
  Description of Artificial Sequence: Synthetic oligonucleotide
ugccuacuccuguccugug

SEQ ID NO: 3548 - RNA, 19 nt, Artificial Sequence
  Description of Artificial Sequence: Synthetic oligonucleotide
cacaggacaggaguaggca

SEQ ID NO: 3549 - RNA, 19 nt, Artificial Sequence
  Description of Artificial Sequence: Synthetic oligonucleotide
gccuacuccuguccugugc

SEQ ID NO: 3550 - RNA, 19 nt, Artificial Sequence
  Description of Artificial Sequence: Synthetic oligonucleotide
gcacaggacaggaguaggc

SEQ ID NO: 3551 - RNA, 19 nt, Artificial Sequence
  Description of Artificial Sequence: Synthetic oligonucleotide
ccuacuccuguccugugcc

SEQ ID NO: 3552 - RNA, 19 nt, Artificial Sequence
  Description of Artificial Sequence: Synthetic oligonucleotide
ggcacaggacaggaguagg

SEQ ID NO: 3553 - RNA, 19 nt, Artificial Sequence
  Description of Artificial Sequence: Synthetic oligonucleotide
cuacuccuguccugugccu

SEQ ID NO: 3554 - RNA, 19 nt, Artificial Sequence
  Description of Artificial Sequence: Synthetic oligonucleotide
aggcacaggacaggaguag

SEQ ID NO: 3555 - RNA, 19 nt, Artificial Sequence
  Description of Artificial Sequence: Synthetic oligonucleotide
uacuccuguccugugccua

SEQ ID NO: 3556 - RNA, 19 nt, Artificial Sequence
  Description of Artificial Sequence: Synthetic oligonucleotide
uaggcacaggacaggagua

SEQ ID NO: 3557 - RNA, 19 nt, Artificial Sequence
  Description of Artificial Sequence: Synthetic oligonucleotide
acuccuguccugugccuau

SEQ ID NO: 3558 - RNA, 19 nt, Artificial Sequence
  Description of Artificial Sequence: Synthetic oligonucleotide
auaggcacaggacaggagu

SEQ ID NO: 3559 - RNA, 19 nt, Artificial Sequence
  Description of Artificial Sequence: Synthetic oligonucleotide
cuccuguccugugccuauc

SEQ ID NO: 3560 - RNA, 19 nt, Artificial Sequence
  Description of Artificial Sequence: Synthetic oligonucleotide
gauaggcacaggacaggag

SEQ ID NO: 3561 - RNA, 19 nt, Artificial Sequence
  Description of Artificial Sequence: Synthetic oligonucleotide
uccuguccugugccuauca

SEQ ID NO: 3562 - RNA, 19 nt, Artificial Sequence
  Description of Artificial Sequence: Synthetic oligonucleotide
ugauaggcacaggacagga

SEQ ID NO: 3563 - RNA, 19 nt, Artificial Sequence
  Description of Artificial Sequence: Synthetic oligonucleotide
gugccuaucacauuugcag

SEQ ID NO: 3564 - RNA, 19 nt, Artificial Sequence
  Description of Artificial Sequence: Synthetic oligonucleotide
cugcaaaugugauaggcac

SEQ ID NO: 3565 - RNA, 19 nt, Artificial Sequence
  Description of Artificial Sequence: Synthetic oligonucleotide
cuaucacauuugcagaggg

SEQ ID NO: 3566 - RNA, 19 nt, Artificial Sequence
  Description of Artificial Sequence: Synthetic oligonucleotide
cccucugcaaaugugauag

SEQ ID NO: 3567 - RNA, 19 nt, Artificial Sequence
  Description of Artificial Sequence: Synthetic oligonucleotide
uaucacauuugcagagggu

SEQ ID NO: 3568 - RNA, 19 nt, Artificial Sequence
  Description of Artificial Sequence: Synthetic oligonucleotide
acccucugcaaaugugaua

SEQ ID NO: 3569 - RNA, 19 nt, Artificial Sequence
  Description of Artificial Sequence: Synthetic oligonucleotide
aucacauuugcagagggua

SEQ ID NO: 3570 - RNA, 19 nt, Artificial Sequence
  Description of Artificial Sequence: Synthetic oligonucleotide
uacccucugcaaaugugau

SEQ ID NO: 3571 - RNA, 19 nt, Artificial Sequence
  Description of Artificial Sequence: Synthetic oligonucleotide
ucacauuugcagaggguaa

SEQ ID NO: 3572 - RNA, 19 nt, Artificial Sequence
  Description of Artificial Sequence: Synthetic oligonucleotide
uuacccucugcaaauguga

SEQ ID NO: 3573 - RNA, 19 nt, Artificial Sequence
  Description of Artificial Sequence: Synthetic oligonucleotide
cacauuugcagaggguaag

SEQ ID NO: 3574 - RNA, 19 nt, Artificial Sequence
  Description of Artificial Sequence: Synthetic oligonucleotide
cuuacccucugcaaaugug

SEQ ID NO: 3575 - RNA, 19 nt, Artificial Sequence
  Description of Artificial Sequence: Synthetic oligonucleotide
acauuugcagaggguaaga

SEQ ID NO: 3576 - RNA, 19 nt, Artificial Sequence
  Description of Artificial Sequence: Synthetic oligonucleotide
ucuuacccucugcaaaugu

SEQ ID NO: 3577 - RNA, 19 nt, Artificial Sequence
  Description of Artificial Sequence: Synthetic oligonucleotide
cucacccugcuccuuccca

SEQ ID NO: 3578 - RNA, 19 nt, Artificial Sequence
  Description of Artificial Sequence: Synthetic oligonucleotide
ugggaaggagcagggugag

SEQ ID NO: 3579 - RNA, 19 nt, Artificial Sequence
  Description of Artificial Sequence: Synthetic oligonucleotide
cacccugcuccuucccauc

SEQ ID NO: 3580 - RNA, 19 nt, Artificial Sequence
  Description of Artificial Sequence: Synthetic oligonucleotide
gaugggaaggagcagggug

SEQ ID NO: 3581 - RNA, 19 nt, Artificial Sequence
  Description of Artificial Sequence: Synthetic oligonucleotide
ccugcuccuucccaucacc

SEQ ID NO: 3582 - RNA, 19 nt, Artificial Sequence
  Description of Artificial Sequence: Synthetic oligonucleotide
ggugaugggaaggagcagg

SEQ ID NO: 3583 - RNA, 19 nt, Artificial Sequence
  Description of Artificial Sequence: Synthetic oligonucleotide
ugcuccuucccaucaccaa

SEQ ID NO: 3584 - RNA, 19 nt, Artificial Sequence
  Description of Artificial Sequence: Synthetic oligonucleotide
uuggugaugggaaggagca

SEQ ID NO: 3585 - RNA, 19 nt, Artificial Sequence
  Description of Artificial Sequence: Synthetic oligonucleotide
caguaagauucccuggugg

SEQ ID NO: 3586 - RNA, 19 nt, Artificial Sequence
  Description of Artificial Sequence: Synthetic oligonucleotide
ccaccagggaaucuuacug

SEQ ID NO: 3587 - RNA, 19 nt, Artificial Sequence
  Description of Artificial Sequence: Synthetic oligonucleotide
aguaagauucccugguggu

SEQ ID NO: 3588 - RNA, 19 nt, Artificial Sequence
  Description of Artificial Sequence: Synthetic oligonucleotide
accaccagggaaucuuacu

SEQ ID NO: 3589 - RNA, 19 nt, Artificial Sequence
  Description of Artificial Sequence: Synthetic oligonucleotide
guaagauucccugguggug

SEQ ID NO: 3590 - RNA, 19 nt, Artificial Sequence
  Description of Artificial Sequence: Synthetic oligonucleotide
caccaccagggaaucuuac

SEQ ID NO: 3591 - RNA, 19 nt, Artificial Sequence
  Description of Artificial Sequence: Synthetic oligonucleotide
uaagauucccugguggugg

SEQ ID NO: 3592 - RNA, 19 nt, Artificial Sequence
  Description of Artificial Sequence: Synthetic oligonucleotide
ccaccaccagggaaucuua

SEQ ID NO: 3593 - RNA, 19 nt, Artificial Sequence
  Description of Artificial Sequence: Synthetic oligonucleotide
aagauucccugguggugga

SEQ ID NO: 3594 - RNA, 19 nt, Artificial Sequence
  Description of Artificial Sequence: Synthetic oligonucleotide
uccaccaccagggaaucuu

SEQ ID NO: 3595 - RNA, 19 nt, Artificial Sequence
  Description of Artificial Sequence: Synthetic oligonucleotide
ucccuggugguggaaggaa

SEQ ID NO: 3596 - RNA, 19 nt, Artificial Sequence
  Description of Artificial Sequence: Synthetic oligonucleotide
uuccuuccaccaccaggga

SEQ ID NO: 3597 - RNA, 19 nt, Artificial Sequence
  Description of Artificial Sequence: Synthetic oligonucleotide
ucugcugaauccugguccu

SEQ ID NO: 3598 - RNA, 19 nt, Artificial Sequence
  Description of Artificial Sequence: Synthetic oligonucleotide
aggaccaggauucagcaga

SEQ ID NO: 3599 - RNA, 19 nt, Artificial Sequence
  Description of Artificial Sequence: Synthetic oligonucleotide
cugcugaauccugguccug

SEQ ID NO: 3600 - RNA, 19 nt, Artificial Sequence
  Description of Artificial Sequence: Synthetic oligonucleotide
caggaccaggauucagcag

SEQ ID NO: 3601 - RNA, 19 nt, Artificial Sequence
  Description of Artificial Sequence: Synthetic oligonucleotide
ugcugaauccugguccugc

SEQ ID NO: 3602 - RNA, 19 nt, Artificial Sequence
  Description of Artificial Sequence: Synthetic oligonucleotide
gcaggaccaggauucagca

SEQ ID NO: 3603 - RNA, 19 nt, Artificial Sequence
  Description of Artificial Sequence: Synthetic oligonucleotide
ugaauccugguccugcuuc

SEQ ID NO: 3604 - RNA, 19 nt, Artificial Sequence
  Description of Artificial Sequence: Synthetic oligonucleotide
gaagcaggaccaggauuca

SEQ ID NO: 3605 - RNA, 19 nt, Artificial Sequence
  Description of Artificial Sequence: Synthetic oligonucleotide
gaauccugguccugcuucu

SEQ ID NO: 3606 - RNA, 19 nt, Artificial Sequence
  Description of Artificial Sequence: Synthetic oligonucleotide
agaagcaggaccaggauuc

SEQ ID NO: 3607 - RNA, 19 nt, Artificial Sequence
  Description of Artificial Sequence: Synthetic oligonucleotide
aauccugguccugcuucug

SEQ ID NO: 3608 - RNA, 19 nt, Artificial Sequence
  Description of Artificial Sequence: Synthetic oligonucleotide
cagaagcaggaccaggauu

SEQ ID NO: 3609 - RNA, 19 nt, Artificial Sequence
  Description of Artificial Sequence: Synthetic oligonucleotide
auccugguccugcuucugu

SEQ ID NO: 3610 - RNA, 19 nt, Artificial Sequence
  Description of Artificial Sequence: Synthetic oligonucleotide
acagaagcaggaccaggau

SEQ ID NO: 3611 - RNA, 19 nt, Artificial Sequence
  Description of Artificial Sequence: Synthetic oligonucleotide
uccugguccugcuucuguu

SEQ ID NO: 3612 - RNA, 19 nt, Artificial Sequence
  Description of Artificial Sequence: Synthetic oligonucleotide
aacagaagcaggaccagga

SEQ ID NO: 3613 - RNA, 19 nt, Artificial Sequence
  Description of Artificial Sequence: Synthetic oligonucleotide
ccugguccugcuucuguuc

SEQ ID NO: 3614 - RNA, 19 nt, Artificial Sequence
  Description of Artificial Sequence: Synthetic oligonucleotide
gaacagaagcaggaccagg

SEQ ID NO: 3615 - RNA, 19 nt, Artificial Sequence
  Description of Artificial Sequence: Synthetic oligonucleotide
cugguccugcuucuguucu

SEQ ID NO: 3616 - RNA, 19 nt, Artificial Sequence
  Description of Artificial Sequence: Synthetic oligonucleotide
agaacagaagcaggaccag

SEQ ID NO: 3617 - RNA, 19 nt, Artificial Sequence
  Description of Artificial Sequence: Synthetic oligonucleotide
uucuguucucaucccuccc

SEQ ID NO: 3618 - RNA, 19 nt, Artificial Sequence
  Description of Artificial Sequence: Synthetic oligonucleotide
gggagggaugagaacagaa

SEQ ID NO: 3619 - RNA, 19 nt, Artificial Sequence
  Description of Artificial Sequence: Synthetic oligonucleotide
cuucugcaguguguauguu

SEQ ID NO: 3620 - RNA, 19 nt, Artificial Sequence
  Description of Artificial Sequence: Synthetic oligonucleotide
aacauacacacugcagaag

SEQ ID NO: 3621 - RNA, 19 nt, Artificial Sequence
  Description of Artificial Sequence: Synthetic oligonucleotide
uucugcaguguguauguug

SEQ ID NO: 3622 - RNA, 19 nt, Artificial Sequence
  Description of Artificial Sequence: Synthetic oligonucleotide
caacauacacacugcagaa

SEQ ID NO: 3623 - RNA, 19 nt, Artificial Sequence
  Description of Artificial Sequence: Synthetic oligonucleotide
ucugcaguguguauguugc

SEQ ID NO: 3624 - RNA, 19 nt, Artificial Sequence
  Description of Artificial Sequence: Synthetic oligonucleotide
gcaacauacacacugcaga

SEQ ID NO: 3625 - RNA, 19 nt, Artificial Sequence
  Description of Artificial Sequence: Synthetic oligonucleotide
cugcaguguguauguugcc

SEQ ID NO: 3626 - RNA, 19 nt, Artificial Sequence
  Description of Artificial Sequence: Synthetic oligonucleotide
ggcaacauacacacugcag

SEQ ID NO: 3627 - RNA, 19 nt, Artificial Sequence
  Description of Artificial Sequence: Synthetic oligonucleotide
ugcaguguguauguugccu

SEQ ID NO: 3628 - RNA, 19 nt, Artificial Sequence
  Description of Artificial Sequence: Synthetic oligonucleotide
aggcaacauacacacugca

SEQ ID NO: 3629 - RNA, 19 nt, Artificial Sequence
  Description of Artificial Sequence: Synthetic oligonucleotide
gcaguguguauguugccug

SEQ ID NO: 3630 - RNA, 19 nt, Artificial Sequence
  Description of Artificial Sequence: Synthetic oligonucleotide
caggcaacauacacacugc

SEQ ID NO: 3631 - RNA, 19 nt, Artificial Sequence
  Description of Artificial Sequence: Synthetic oligonucleotide
caguguguauguugccugg

SEQ ID NO: 3632 - RNA, 19 nt, Artificial Sequence
  Description of Artificial Sequence: Synthetic oligonucleotide
ccaggcaacauacacacug

SEQ ID NO: 3633 - RNA, 19 nt, Artificial Sequence
  Description of Artificial Sequence: Synthetic oligonucleotide
aguguguauguugccuggu

SEQ ID NO: 3634 - RNA, 19 nt, Artificial Sequence
  Description of Artificial Sequence: Synthetic oligonucleotide
accaggcaacauacacacu

SEQ ID NO: 3635 - RNA, 19 nt, Artificial Sequence
  Description of Artificial Sequence: Synthetic oligonucleotide
guguguauguugccugguc

SEQ ID NO: 3636 - RNA, 19 nt, Artificial Sequence
  Description of Artificial Sequence: Synthetic oligonucleotide
gaccaggcaacauacacac

SEQ ID NO: 3637 - RNA, 19 nt, Artificial Sequence
  Description of Artificial Sequence: Synthetic oligonucleotide
uguguauguugccuggucu

SEQ ID NO: 3638 - RNA, 19 nt, Artificial Sequence
  Description of Artificial Sequence: Synthetic oligonucleotide
agaccaggcaacauacaca

SEQ ID NO: 3639 - RNA, 19 nt, Artificial Sequence
  Description of Artificial Sequence: Synthetic oligonucleotide
guguauguugccuggucuc

SEQ ID NO: 3640 - RNA, 19 nt, Artificial Sequence
  Description of Artificial Sequence: Synthetic oligonucleotide
gagaccaggcaacauacac

SEQ ID NO: 3641 - RNA, 19 nt, Artificial Sequence
  Description of Artificial Sequence: Synthetic oligonucleotide
uguauguugccuggucucu

SEQ ID NO: 3642 - RNA, 19 nt, Artificial Sequence
  Description of Artificial Sequence: Synthetic oligonucleotide
agagaccaggcaacauaca

SEQ ID NO: 3643 - RNA, 19 nt, Artificial Sequence
  Description of Artificial Sequence: Synthetic oligonucleotide
guauguugccuggucucuc

SEQ ID NO: 3644 - RNA, 19 nt, Artificial Sequence
  Description of Artificial Sequence: Synthetic oligonucleotide
gagagaccaggcaacauac

SEQ ID NO: 3645 - RNA, 19 nt, Artificial Sequence
  Description of Artificial Sequence: Synthetic oligonucleotide
uauguugccuggucucucu

SEQ ID NO: 3646 - RNA, 19 nt, Artificial Sequence
  Description of Artificial Sequence: Synthetic oligonucleotide
agagagaccaggcaacaua

SEQ ID NO: 3647 - RNA, 19 nt, Artificial Sequence
  Description of Artificial Sequence: Synthetic oligonucleotide
auguugccuggucucucug

SEQ ID NO: 3648 - RNA, 19 nt, Artificial Sequence
  Description of Artificial Sequence: Synthetic oligonucleotide
cagagagaccaggcaacau

SEQ ID NO: 3649 - RNA, 19 nt, Artificial Sequence
  Description of Artificial Sequence: Synthetic oligonucleotide
uguugccuggucucucugg

SEQ ID NO: 3650 - RNA, 19 nt, Artificial Sequence
  Description of Artificial Sequence: Synthetic oligonucleotide
ccagagagaccaggcaaca

SEQ ID NO: 3651 - RNA, 19 nt, Artificial Sequence
  Description of Artificial Sequence: Synthetic oligonucleotide
guugccuggucucucuggc

SEQ ID NO: 3652 - RNA, 19 nt, Artificial Sequence
  Description of Artificial Sequence: Synthetic oligonucleotide
gccagagagaccaggcaac

SEQ ID NO: 3653 - RNA, 19 nt, Artificial Sequence
  Description of Artificial Sequence: Synthetic oligonucleotide
uugccuggucucucuggcc

SEQ ID NO: 3654 - RNA, 19 nt, Artificial Sequence
  Description of Artificial Sequence: Synthetic oligonucleotide
ggccagagagaccaggcaa

SEQ ID NO: 3655 - RNA, 19 nt, Artificial Sequence
  Description of Artificial Sequence: Synthetic oligonucleotide
cuggucucucuggccugca

SEQ ID NO: 3656 - RNA, 19 nt, Artificial Sequence
  Description of Artificial Sequence: Synthetic oligonucleotide
ugcaggccagagagaccag

SEQ ID NO: 3657 - RNA, 19 nt, Artificial Sequence
  Description of Artificial Sequence: Synthetic oligonucleotide
ccugcagaggugacccaaa

SEQ ID NO: 3658 - RNA, 19 nt, Artificial Sequence
  Description of Artificial Sequence: Synthetic oligonucleotide
uuugggucaccucugcagg

SEQ ID NO: 3659 - RNA, 19 nt, Artificial Sequence
  Description of Artificial Sequence: Synthetic oligonucleotide
cugccuuauccuugccugu

SEQ ID NO: 3660 - RNA, 19 nt, Artificial Sequence
  Description of Artificial Sequence: Synthetic oligonucleotide
acaggcaaggauaaggcag

SEQ ID NO: 3661 - RNA, 19 nt, Artificial Sequence
  Description of Artificial Sequence: Synthetic oligonucleotide
ugccuuauccuugccuguu

SEQ ID NO: 3662 - RNA, 19 nt, Artificial Sequence
  Description of Artificial Sequence: Synthetic oligonucleotide
aacaggcaaggauaaggca

SEQ ID NO: 3663 - RNA, 19 nt, Artificial Sequence
  Description of Artificial Sequence: Synthetic oligonucleotide
gccuuauccuugccuguuu

SEQ ID NO: 3664 - RNA, 19 nt, Artificial Sequence
  Description of Artificial Sequence: Synthetic oligonucleotide
aaacaggcaaggauaaggc

SEQ ID NO: 3665 - RNA, 19 nt, Artificial Sequence
  Description of Artificial Sequence: Synthetic oligonucleotide
agucuccugguccggcuga

SEQ ID NO: 3666 - RNA, 19 nt, Artificial Sequence
  Description of Artificial Sequence: Synthetic oligonucleotide
ucagccggaccaggagacu

SEQ ID NO: 3667 - RNA, 19 nt, Artificial Sequence
  Description of Artificial Sequence: Synthetic oligonucleotide
gucaaugacagcuuuucca

SEQ ID NO: 3668 - RNA, 19 nt, Artificial Sequence
  Description of Artificial Sequence: Synthetic oligonucleotide
uggaaaagcugucauugac

SEQ ID NO: 3669 - RNA, 19 nt, Artificial Sequence
  Description of Artificial Sequence: Synthetic oligonucleotide
ugacagcuuuuccauguaa

SEQ ID NO: 3670 - RNA, 19 nt, Artificial Sequence
  Description of Artificial Sequence: Synthetic oligonucleotide
uuacauggaaaagcuguca

SEQ ID NO: 3671 - RNA, 19 nt, Artificial Sequence
  Description of Artificial Sequence: Synthetic oligonucleotide
gacagcuuuuccauguaag

SEQ ID NO: 3672 - RNA, 19 nt, Artificial Sequence
  Description of Artificial Sequence: Synthetic oligonucleotide
cuuacauggaaaagcuguc

SEQ ID NO: 3673 - RNA, 19 nt, Artificial Sequence
  Description of Artificial Sequence: Synthetic oligonucleotide
acagcuuuuccauguaagg

SEQ ID NO: 3674 - RNA, 19 nt, Artificial Sequence
  Description of Artificial Sequence: Synthetic oligonucleotide
ccuuacauggaaaagcugu

SEQ ID NO: 3675 - RNA, 19 nt, Artificial Sequence
  Description of Artificial Sequence: Synthetic oligonucleotide
cagcuuuuccauguaaggc

SEQ ID NO: 3676 - RNA, 19 nt, Artificial Sequence
  Description of Artificial Sequence: Synthetic oligonucleotide
gccuuacauggaaaagcug

SEQ ID NO: 3677 - RNA, 19 nt, Artificial Sequence
  Description of Artificial Sequence: Synthetic oligonucleotide
agcuuuuccauguaaggca

SEQ ID NO: 3678 - RNA, 19 nt, Artificial Sequence
  Description of Artificial Sequence: Synthetic oligonucleotide
ugccuuacauggaaaagcu

SEQ ID NO: 3679 - RNA, 19 nt, Artificial Sequence
  Description of Artificial Sequence: Synthetic oligonucleotide
uguaaggcauggugcuagg

SEQ ID NO: 3680 - RNA, 19 nt, Artificial Sequence
  Description of Artificial Sequence: Synthetic oligonucleotide
ccuagcaccaugccuuaca

SEQ ID NO: 3681 - RNA, 19 nt, Artificial Sequence
  Description of Artificial Sequence: Synthetic oligonucleotide
guaaggcauggugcuaggu

SEQ ID NO: 3682 - RNA, 19 nt, Artificial Sequence
  Description of Artificial Sequence: Synthetic oligonucleotide
accuagcaccaugccuuac

SEQ ID NO: 3683 - RNA, 19 nt, Artificial Sequence
  Description of Artificial Sequence: Synthetic oligonucleotide
uaaggcauggugcuagguu

SEQ ID NO: 3684 - RNA, 19 nt, Artificial Sequence
  Description of Artificial Sequence: Synthetic oligonucleotide
aaccuagcaccaugccuua

SEQ ID NO: 3685 - RNA, 19 nt, Artificial Sequence
  Description of Artificial Sequence: Synthetic oligonucleotide
gcauggugcuagguuccag

SEQ ID NO: 3686 - RNA, 19 nt, Artificial Sequence
  Description of Artificial Sequence: Synthetic oligonucleotide
cuggaaccuagcaccaugc

SEQ ID NO: 3687 - RNA, 19 nt, Artificial Sequence
  Description of Artificial Sequence: Synthetic oligonucleotide
cauggugcuagguuccagg

SEQ ID NO: 3688 - RNA, 19 nt, Artificial Sequence
  Description of Artificial Sequence: Synthetic oligonucleotide
ccuggaaccuagcaccaug

SEQ ID NO: 3689 - RNA, 19 nt, Artificial Sequence
  Description of Artificial Sequence: Synthetic oligonucleotide
auggugcuagguuccagga

SEQ ID NO: 3690 - RNA, 19 nt, Artificial Sequence
  Description of Artificial Sequence: Synthetic oligonucleotide
uccuggaaccuagcaccau

SEQ ID NO: 3691 - RNA, 19 nt, Artificial Sequence
  Description of Artificial Sequence: Synthetic oligonucleotide
uggugcuagguuccaggag

SEQ ID NO: 3692 - RNA, 19 nt, Artificial Sequence
  Description of Artificial Sequence: Synthetic oligonucleotide
cuccuggaaccuagcacca

SEQ ID NO: 3693 - RNA, 19 nt, Artificial Sequence
  Description of Artificial Sequence: Synthetic oligonucleotide
ggugcuagguuccaggagg

SEQ ID NO: 3694 - RNA, 19 nt, Artificial Sequence
  Description of Artificial Sequence: Synthetic oligonucleotide
ccuccuggaaccuagcacc

SEQ ID NO: 3695 - RNA, 19 nt, Artificial Sequence
  Description of Artificial Sequence: Synthetic oligonucleotide
gugcuagguuccaggagga

SEQ ID NO: 3696 - RNA, 19 nt, Artificial Sequence
  Description of Artificial Sequence: Synthetic oligonucleotide
uccuccuggaaccuagcac

SEQ ID NO: 3697 - RNA, 19 nt, Artificial Sequence
  Description of Artificial Sequence: Synthetic oligonucleotide
ugcauggaggcauaauggu

SEQ ID NO: 3698 - RNA, 19 nt, Artificial Sequence
  Description of Artificial Sequence: Synthetic oligonucleotide
accauuaugccuccaugca

SEQ ID NO: 3699 - RNA, 19 nt, Artificial Sequence
  Description of Artificial Sequence: Synthetic oligonucleotide
gcauggaggcauaaugguu

SEQ ID NO: 3700 - RNA, 19 nt, Artificial Sequence
  Description of Artificial Sequence: Synthetic oligonucleotide
aaccauuaugccuccaugc

SEQ ID NO: 3701 - RNA, 19 nt, Artificial Sequence
  Description of Artificial Sequence: Synthetic oligonucleotide
cauggaggcauaaugguua

SEQ ID NO: 3702 - RNA, 19 nt, Artificial Sequence
  Description of Artificial Sequence: Synthetic oligonucleotide
uaaccauuaugccuccaug

SEQ ID NO: 3703 - RNA, 19 nt, Artificial Sequence
  Description of Artificial Sequence: Synthetic oligonucleotide
auggaggcauaaugguuag

SEQ ID NO: 3704 - RNA, 19 nt, Artificial Sequence
  Description of Artificial Sequence: Synthetic oligonucleotide
cuaaccauuaugccuccau

SEQ ID NO: 3705 - RNA, 19 nt, Artificial Sequence
  Description of Artificial Sequence: Synthetic oligonucleotide
uggaggcauaaugguuagg

SEQ ID NO: 3706 - RNA, 19 nt, Artificial Sequence
  Description of Artificial Sequence: Synthetic oligonucleotide
ccuaaccauuaugccucca

SEQ ID NO: 3707 - RNA, 19 nt, Artificial Sequence
  Description of Artificial Sequence: Synthetic oligonucleotide
ggaggcauaaugguuaggg

SEQ ID NO: 3708 - RNA, 19 nt, Artificial Sequence
  Description of Artificial Sequence: Synthetic oligonucleotide
cccuaaccauuaugccucc

SEQ ID NO: 3709 - RNA, 19 nt, Artificial Sequence
  Description of Artificial Sequence: Synthetic oligonucleotide
gaggcauaaugguuaggga

SEQ ID NO: 3710 - RNA, 19 nt, Artificial Sequence
  Description of Artificial Sequence: Synthetic oligonucleotide
ucccuaaccauuaugccuc

SEQ ID NO: 3711 - RNA, 19 nt, Artificial Sequence
  Description of Artificial Sequence: Synthetic oligonucleotide
cauaaugguuagggaguca

SEQ ID NO: 3712 - RNA, 19 nt, Artificial Sequence
  Description of Artificial Sequence: Synthetic oligonucleotide
ugacucccuaaccauuaug

SEQ ID NO: 3713 - RNA, 19 nt, Artificial Sequence
  Description of Artificial Sequence: Synthetic oligonucleotide
auaaugguuagggagucau

SEQ ID NO: 3714 - RNA, 19 nt, Artificial Sequence
  Description of Artificial Sequence: Synthetic oligonucleotide
augacucccuaaccauuau

SEQ ID NO: 3715 - RNA, 19 nt, Artificial Sequence
  Description of Artificial Sequence: Synthetic oligonucleotide
uaaugguuagggagucaug

SEQ ID NO: 3716 - RNA, 19 nt, Artificial Sequence
  Description of Artificial Sequence: Synthetic oligonucleotide
caugacucccuaaccauua

SEQ ID NO: 3717 - RNA, 19 nt, Artificial Sequence
  Description of Artificial Sequence: Synthetic oligonucleotide
gguuagggagucaugacac

SEQ ID NO: 3718 - RNA, 19 nt, Artificial Sequence
  Description of Artificial Sequence: Synthetic oligonucleotide
gugucaugacucccuaacc

SEQ ID NO: 3719 - RNA, 19 nt, Artificial Sequence
  Description of Artificial Sequence: Synthetic oligonucleotide
cauuaccaggcugcaccag

SEQ ID NO: 3720 - RNA, 19 nt, Artificial Sequence
  Description of Artificial Sequence: Synthetic oligonucleotide
cuggugcagccugguaaug

SEQ ID NO: 3721 - RNA, 19 nt, Artificial Sequence
  Description of Artificial Sequence: Synthetic oligonucleotide
auuaccaggcugcaccagg

SEQ ID NO: 3722 - RNA, 19 nt, Artificial Sequence
  Description of Artificial Sequence: Synthetic oligonucleotide
ccuggugcagccugguaau

SEQ ID NO: 3723 - RNA, 19 nt, Artificial Sequence
  Description of Artificial Sequence: Synthetic oligonucleotide
uaccaggcugcaccaggau

SEQ ID NO: 3724 - RNA, 19 nt, Artificial Sequence
  Description of Artificial Sequence: Synthetic oligonucleotide
auccuggugcagccuggua

SEQ ID NO: 3725 - RNA, 19 nt, Artificial Sequence
  Description of Artificial Sequence: Synthetic oligonucleotide
accaggcugcaccaggaua

SEQ ID NO: 3726 - RNA, 19 nt, Artificial Sequence
  Description of Artificial Sequence: Synthetic oligonucleotide
uauccuggugcagccuggu

SEQ ID NO: 3727 - RNA, 19 nt, Artificial Sequence
  Description of Artificial Sequence: Synthetic oligonucleotide
ccaggcugcaccaggauac

SEQ ID NO: 3728 - RNA, 19 nt, Artificial Sequence
  Description of Artificial Sequence: Synthetic oligonucleotide
guauccuggugcagccugg

SEQ ID NO: 3729 - RNA, 19 nt, Artificial Sequence
  Description of Artificial Sequence: Synthetic oligonucleotide
aaaggaugaguagggacau

SEQ ID NO: 3730 - RNA, 19 nt, Artificial Sequence
  Description of Artificial Sequence: Synthetic oligonucleotide
augucccuacucauccuuu

SEQ ID NO: 3731 - RNA, 19 nt, Artificial Sequence
  Description of Artificial Sequence: Synthetic oligonucleotide
aaggaugaguagggacaua

SEQ ID NO: 3732 - RNA, 19 nt, Artificial Sequence
  Description of Artificial Sequence: Synthetic oligonucleotide
uaugucccuacucauccuu

SEQ ID NO: 3733 - RNA, 19 nt, Artificial Sequence
  Description of Artificial Sequence: Synthetic oligonucleotide
aggaugaguagggacauac

SEQ ID NO: 3734 - RNA, 19 nt, Artificial Sequence
  Description of Artificial Sequence: Synthetic oligonucleotide
guaugucccuacucauccu

SEQ ID NO: 3735 - RNA, 19 nt, Artificial Sequence
  Description of Artificial Sequence: Synthetic oligonucleotide
guagggacauacuaagaag

SEQ ID NO: 3736 - RNA, 19 nt, Artificial Sequence
  Description of Artificial Sequence: Synthetic oligonucleotide
cuucuuaguaugucccuac

SEQ ID NO: 3737 - RNA, 19 nt, Artificial Sequence
  Description of Artificial Sequence: Synthetic oligonucleotide
ggacauacuaagaagcagc

SEQ ID NO: 3738 - RNA, 19 nt, Artificial Sequence
  Description of Artificial Sequence: Synthetic oligonucleotide
gcugcuucuuaguaugucc

SEQ ID NO: 3739 - RNA, 19 nt, Artificial Sequence
  Description of Artificial Sequence: Synthetic oligonucleotide
auacuaagaagcagcccuc

SEQ ID NO: 3740 - RNA, 19 nt, Artificial Sequence
  Description of Artificial Sequence: Synthetic oligonucleotide
gagggcugcuucuuaguau

SEQ ID NO: 3741 - RNA, 19 nt, Artificial Sequence
  Description of Artificial Sequence: Synthetic oligonucleotide
uacuaagaagcagcccucu

SEQ ID NO: 3742 - RNA, 19 nt, Artificial Sequence
  Description of Artificial Sequence: Synthetic oligonucleotide
agagggcugcuucuuagua

SEQ ID NO: 3743 - RNA, 19 nt, Artificial Sequence
  Description of Artificial Sequence: Synthetic oligonucleotide
acuaagaagcagcccucuc

SEQ ID NO: 3744 - RNA, 19 nt, Artificial Sequence
  Description of Artificial Sequence: Synthetic oligonucleotide
gagagggcugcuucuuagu

SEQ ID NO: 3745 - RNA, 19 nt, Artificial Sequence
  Description of Artificial Sequence: Synthetic oligonucleotide
agaagcagcccucuccucu

SEQ ID NO: 3746 - RNA, 19 nt, Artificial Sequence
  Description of Artificial Sequence: Synthetic oligonucleotide
agaggagagggcugcuucu

SEQ ID NO: 3747 - RNA, 19 nt, Artificial Sequence
  Description of Artificial Sequence: Synthetic oligonucleotide
gaagcagcccucuccucuu

SEQ ID NO: 3748 - RNA, 19 nt, Artificial Sequence
  Description of Artificial Sequence: Synthetic oligonucleotide
aagaggagagggcugcuuc

SEQ ID NO: 3749 - RNA, 19 nt, Artificial Sequence
  Description of Artificial Sequence: Synthetic oligonucleotide
cagcccucuccucuuggaa

SEQ ID NO: 3750 - RNA, 19 nt, Artificial Sequence
  Description of Artificial Sequence: Synthetic oligonucleotide
uuccaagaggagagggcug

SEQ ID NO: 3751 - RNA, 19 nt, Artificial Sequence
  Description of Artificial Sequence: Synthetic oligonucleotide
gccuggcagauggauagag

SEQ ID NO: 3752 - RNA, 19 nt, Artificial Sequence
  Description of Artificial Sequence: Synthetic oligonucleotide
cucuauccaucugccaggc

SEQ ID NO: 3753 - RNA, 19 nt, Artificial Sequence
  Description of Artificial Sequence: Synthetic oligonucleotide
ccuggcagauggauagagc

SEQ ID NO: 3754 - RNA, 19 nt, Artificial Sequence
  Description of Artificial Sequence: Synthetic oligonucleotide
gcucuauccaucugccagg

SEQ ID NO: 3755 - RNA, 19 nt, Artificial Sequence
  Description of Artificial Sequence: Synthetic oligonucleotide
cuggcagauggauagagcu

SEQ ID NO: 3756 - RNA, 19 nt, Artificial Sequence
  Description of Artificial Sequence: Synthetic oligonucleotide
agcucuauccaucugccag

SEQ ID NO: 3757 - RNA, 19 nt, Artificial Sequence
  Description of Artificial Sequence: Synthetic oligonucleotide
uggcagauggauagagcug

SEQ ID NO: 3758 - RNA, 19 nt, Artificial Sequence
  Description of Artificial Sequence: Synthetic oligonucleotide
cagcucuauccaucugcca

SEQ ID NO: 3759 - RNA, 19 nt, Artificial Sequence
  Description of Artificial Sequence: Synthetic oligonucleotide
ggcagauggauagagcugg

SEQ ID NO: 3760 - RNA, 19 nt, Artificial Sequence
  Description of Artificial Sequence: Synthetic oligonucleotide
ccagcucuauccaucugcc

SEQ ID NO: 3761 - RNA, 19 nt, Artificial Sequence
  Description of Artificial Sequence: Synthetic oligonucleotide
gcagauggauagagcuggg

SEQ ID NO: 3762 - RNA, 19 nt, Artificial Sequence
  Description of Artificial Sequence: Synthetic oligonucleotide
cccagcucuauccaucugc

SEQ ID NO: 3763 - RNA, 19 nt, Artificial Sequence
  Description of Artificial Sequence: Synthetic oligonucleotide
aaaggccucugcucaagua

SEQ ID NO: 3764 - RNA, 19 nt, Artificial Sequence
  Description of Artificial Sequence: Synthetic oligonucleotide
uacuugagcagaggccuuu

SEQ ID NO: 3765 - RNA, 19 nt, Artificial Sequence
  Description of Artificial Sequence: Synthetic oligonucleotide
aaggccucugcucaaguaa

SEQ ID NO: 3766 - RNA, 19 nt, Artificial Sequence
  Description of Artificial Sequence: Synthetic oligonucleotide
uuacuugagcagaggccuu

SEQ ID NO: 3767 - RNA, 19 nt, Artificial Sequence
  Description of Artificial Sequence: Synthetic oligonucleotide
aggccucugcucaaguaac

SEQ ID NO: 3768 - RNA, 19 nt, Artificial Sequence
  Description of Artificial Sequence: Synthetic oligonucleotide
guuacuugagcagaggccu

SEQ ID NO: 3769 - RNA, 19 nt, Artificial Sequence
  Description of Artificial Sequence: Synthetic oligonucleotide
caggagcacugucuuaguu

SEQ ID NO: 3770 - RNA, 19 nt, Artificial Sequence
  Description of Artificial Sequence: Synthetic oligonucleotide
aacuaagacagugcuccug

SEQ ID NO: 3771 - RNA, 19 nt, Artificial Sequence
  Description of Artificial Sequence: Synthetic oligonucleotide
aggagcacugucuuaguuu

SEQ ID NO: 3772 - RNA, 19 nt, Artificial Sequence
  Description of Artificial Sequence: Synthetic oligonucleotide
aaacuaagacagugcuccu

SEQ ID NO: 3773 - RNA, 19 nt, Artificial Sequence
  Description of Artificial Sequence: Synthetic oligonucleotide
ggagcacugucuuaguuug

SEQ ID NO: 3774 - RNA, 19 nt, Artificial Sequence
  Description of Artificial Sequence: Synthetic oligonucleotide
caaacuaagacagugcucc

SEQ ID NO: 3775 - RNA, 19 nt, Artificial Sequence
  Description of Artificial Sequence: Synthetic oligonucleotide
gagcacugucuuaguuugg

SEQ ID NO: 3776 - RNA, 19 nt, Artificial Sequence
  Description of Artificial Sequence: Synthetic oligonucleotide
ccaaacuaagacagugcuc

SEQ ID NO: 3777 - RNA, 19 nt, Artificial Sequence
  Description of Artificial Sequence: Synthetic oligonucleotide
agcacugucuuaguuuggg

SEQ ID NO: 3778 - RNA, 19 nt, Artificial Sequence
  Description of Artificial Sequence: Synthetic oligonucleotide
cccaaacuaagacagugcu

SEQ ID NO: 3779 - RNA, 19 nt, Artificial Sequence
  Description of Artificial Sequence: Synthetic oligonucleotide
guucuuccaaagcagagcu

SEQ ID NO: 3780 - RNA, 19 nt, Artificial Sequence
  Description of Artificial Sequence: Synthetic oligonucleotide
agcucugcuuuggaagaac

SEQ ID NO: 3781 - RNA, 19 nt, Artificial Sequence
  Description of Artificial Sequence: Synthetic oligonucleotide
agcagagcuugagcuaagg

SEQ ID NO: 3782 - RNA, 19 nt, Artificial Sequence
  Description of Artificial Sequence: Synthetic oligonucleotide
ccuuagcucaagcucugcu

SEQ ID NO: 3783 - RNA, 19 nt, Artificial Sequence
  Description of Artificial Sequence: Synthetic oligonucleotide
gcagagcuugagcuaaggg

SEQ ID NO: 3784 - RNA, 19 nt, Artificial Sequence
  Description of Artificial Sequence: Synthetic oligonucleotide
cccuuagcucaagcucugc

SEQ ID NO: 3785 - RNA, 19 nt, Artificial Sequence
  Description of Artificial Sequence: Synthetic oligonucleotide
cagagcuugagcuaagggc

SEQ ID NO: 3786 - RNA, 19 nt, Artificial Sequence
  Description of Artificial Sequence: Synthetic oligonucleotide
gcccuuagcucaagcucug

SEQ ID NO: 3787 - RNA, 19 nt, Artificial Sequence
  Description of Artificial Sequence: Synthetic oligonucleotide
gcuugagcuaagggcuugg

SEQ ID NO: 3788 - RNA, 19 nt, Artificial Sequence
  Description of Artificial Sequence: Synthetic oligonucleotide
ccaagcccuuagcucaagc

SEQ ID NO: 3789 - RNA, 19 nt, Artificial Sequence
  Description of Artificial Sequence: Synthetic oligonucleotide
uugagcuaagggcuugggu

SEQ ID NO: 3790 - RNA, 19 nt, Artificial Sequence
  Description of Artificial Sequence: Synthetic oligonucleotide
acccaagcccuuagcucaa

SEQ ID NO: 3791 - RNA, 19 nt, Artificial Sequence
  Description of Artificial Sequence: Synthetic oligonucleotide
ugagcuaagggcuugggua

SEQ ID NO: 3792 - RNA, 19 nt, Artificial Sequence
  Description of Artificial Sequence: Synthetic oligonucleotide
uacccaagcccuuagcuca

SEQ ID NO: 3793 - RNA, 19 nt, Artificial Sequence
  Description of Artificial Sequence: Synthetic oligonucleotide
gagcuaagggcuuggguac

SEQ ID NO: 3794 - RNA, 19 nt, Artificial Sequence
  Description of Artificial Sequence: Synthetic oligonucleotide
guacccaagcccuuagcuc

SEQ ID NO: 3795 - RNA, 19 nt, Artificial Sequence
  Description of Artificial Sequence: Synthetic oligonucleotide
agcuaagggcuuggguaca

SEQ ID NO: 3796 - RNA, 19 nt, Artificial Sequence
  Description of Artificial Sequence: Synthetic oligonucleotide
uguacccaagcccuuagcu

SEQ ID NO: 3797 - RNA, 19 nt, Artificial Sequence
  Description of Artificial Sequence: Synthetic oligonucleotide
gcuaagggcuuggguacag

SEQ ID NO: 3798 - RNA, 19 nt, Artificial Sequence
  Description of Artificial Sequence: Synthetic oligonucleotide
cuguacccaagcccuuagc

SEQ ID NO: 3799 - RNA, 19 nt, Artificial Sequence
  Description of Artificial Sequence: Synthetic oligonucleotide
agggcuuggguacagguga

SEQ ID NO: 3800 - RNA, 19 nt, Artificial Sequence
  Description of Artificial Sequence: Synthetic oligonucleotide
ucaccuguacccaagcccu

SEQ ID NO: 3801 - RNA, 19 nt, Artificial Sequence
  Description of Artificial Sequence: Synthetic oligonucleotide
gggcuuggguacaggugau

SEQ ID NO: 3802 - RNA, 19 nt, Artificial Sequence
  Description of Artificial Sequence: Synthetic oligonucleotide
aucaccuguacccaagccc

SEQ ID NO: 3803 - RNA, 19 nt, Artificial Sequence
  Description of Artificial Sequence: Synthetic oligonucleotide
ggcuuggguacaggugauc

SEQ ID NO: 3804 - RNA, 19 nt, Artificial Sequence
  Description of Artificial Sequence: Synthetic oligonucleotide
gaucaccuguacccaagcc

SEQ ID NO: 3805 - RNA, 19 nt, Artificial Sequence
  Description of Artificial Sequence: Synthetic oligonucleotide
gcuuggguacaggugaucc

SEQ ID NO: 3806 - RNA, 19 nt, Artificial Sequence
  Description of Artificial Sequence: Synthetic oligonucleotide
ggaucaccuguacccaagc

SEQ ID NO: 3807 - RNA, 19 nt, Artificial Sequence
  Description of Artificial Sequence: Synthetic oligonucleotide
aggugauccuguauucuug

SEQ ID NO: 3808 - RNA, 19 nt, Artificial Sequence
  Description of Artificial Sequence: Synthetic oligonucleotide
caagaauacaggaucaccu

SEQ ID NO: 3809 - RNA, 19 nt, Artificial Sequence
  Description of Artificial Sequence: Synthetic oligonucleotide
ggugauccuguauucuuga

SEQ ID NO: 3810 - RNA, 19 nt, Artificial Sequence
  Description of Artificial Sequence: Synthetic oligonucleotide
ucaagaauacaggaucacc

SEQ ID NO: 3811 - RNA, 19 nt, Artificial Sequence
  Description of Artificial Sequence: Synthetic oligonucleotide
gugauccuguauucuugag

SEQ ID NO: 3812 - RNA, 19 nt, Artificial Sequence
  Description of Artificial Sequence: Synthetic oligonucleotide
cucaagaauacaggaucac

SEQ ID NO: 3813 - RNA, 19 nt, Artificial Sequence
  Description of Artificial Sequence: Synthetic oligonucleotide
ugauccuguauucuugagc

SEQ ID NO: 3814 - RNA, 19 nt, Artificial Sequence
  Description of Artificial Sequence: Synthetic oligonucleotide
gcucaagaauacaggauca

SEQ ID NO: 3815 - RNA, 19 nt, Artificial Sequence
  Description of Artificial Sequence: Synthetic oligonucleotide
uccuguauucuugagcuaa

SEQ ID NO: 3816 - RNA, 19 nt, Artificial Sequence
  Description of Artificial Sequence: Synthetic oligonucleotide
uuagcucaagaauacagga

SEQ ID NO: 3817 - RNA, 19 nt, Artificial Sequence
  Description of Artificial Sequence: Synthetic oligonucleotide
ccuguauucuugagcuaag

SEQ ID NO: 3818 - RNA, 19 nt, Artificial Sequence
  Description of Artificial Sequence: Synthetic oligonucleotide
cuuagcucaagaauacagg

SEQ ID NO: 3819 - RNA, 19 nt, Artificial Sequence
  Description of Artificial Sequence: Synthetic oligonucleotide
uguauucuugagcuaaggg

SEQ ID NO: 3820 - RNA, 19 nt, Artificial Sequence
  Description of Artificial Sequence: Synthetic oligonucleotide
cccuuagcucaagaauaca

SEQ ID NO: 3821 - RNA, 19 nt, Artificial Sequence
  Description of Artificial Sequence: Synthetic oligonucleotide
guauucuugagcuaagggc

SEQ ID NO: 3822 - RNA, 19 nt, Artificial Sequence
  Description of Artificial Sequence: Synthetic oligonucleotide
gcccuuagcucaagaauac

SEQ ID NO: 3823 - RNA, 19 nt, Artificial Sequence
  Description of Artificial Sequence: Synthetic oligonucleotide
ucuugagcuaagggcuugg

SEQ ID NO: 3824 - RNA, 19 nt, Artificial Sequence
  Description of Artificial Sequence: Synthetic oligonucleotide
ccaagcccuuagcucaaga

SEQ ID NO: 3825 - RNA, 19 nt, Artificial Sequence
  Description of Artificial Sequence: Synthetic oligonucleotide
uugagcuaagggcuugggu

SEQ ID NO: 3826 - RNA, 19 nt, Artificial Sequence
  Description of Artificial Sequence: Synthetic oligonucleotide
acccaagcccuuagcucaa

SEQ ID NO: 3827 - RNA, 19 nt, Artificial Sequence
  Description of Artificial Sequence: Synthetic oligonucleotide
ugagcuaagggcuugggua

SEQ ID NO: 3828 - RNA, 19 nt, Artificial Sequence
  Description of Artificial Sequence: Synthetic oligonucleotide
uacccaagcccuuagcuca

SEQ ID NO: 3829 - RNA, 19 nt, Artificial Sequence
  Description of Artificial Sequence: Synthetic oligonucleotide
gagcuaagggcuuggguac

SEQ ID NO: 3830 - RNA, 19 nt, Artificial Sequence
  Description of Artificial Sequence: Synthetic oligonucleotide
guacccaagcccuuagcuc

SEQ ID NO: 3831 - RNA, 19 nt, Artificial Sequence
  Description of Artificial Sequence: Synthetic oligonucleotide
agcuaagggcuuggguaca

SEQ ID NO: 3832 - RNA, 19 nt, Artificial Sequence
  Description of Artificial Sequence: Synthetic oligonucleotide
uguacccaagcccuuagcu

SEQ ID NO: 3833 - RNA, 19 nt, Artificial Sequence
  Description of Artificial Sequence: Synthetic oligonucleotide
gcuaagggcuuggguacag

SEQ ID NO: 3834 - RNA, 19 nt, Artificial Sequence
  Description of Artificial Sequence: Synthetic oligonucleotide
cuguacccaagcccuuagc

SEQ ID NO: 3835 - RNA, 19 nt, Artificial Sequence
  Description of Artificial Sequence: Synthetic oligonucleotide
agggcuuggguacagguga

SEQ ID NO: 3836 - RNA, 19 nt, Artificial Sequence
  Description of Artificial Sequence: Synthetic oligonucleotide
ucaccuguacccaagcccu

SEQ ID NO: 3837 - RNA, 19 nt, Artificial Sequence
  Description of Artificial Sequence: Synthetic oligonucleotide
gggcuuggguacaggugau

SEQ ID NO: 3838 - RNA, 19 nt, Artificial Sequence
  Description of Artificial Sequence: Synthetic oligonucleotide
aucaccuguacccaagccc

SEQ ID NO: 3839 - RNA, 19 nt, Artificial Sequence
  Description of Artificial Sequence: Synthetic oligonucleotide
ggcuuggguacaggugauc

SEQ ID NO: 3840 - RNA, 19 nt, Artificial Sequence
  Description of Artificial Sequence: Synthetic oligonucleotide
gaucaccuguacccaagcc

SEQ ID NO: 3841 - RNA, 19 nt, Artificial Sequence
  Description of Artificial Sequence: Synthetic oligonucleotide
gcuuggguacaggugaucc

SEQ ID NO: 3842 - RNA, 19 nt, Artificial Sequence
  Description of Artificial Sequence: Synthetic oligonucleotide
ggaucaccuguacccaagc

SEQ ID NO: 3843 - RNA, 19 nt, Artificial Sequence
  Description of Artificial Sequence: Synthetic oligonucleotide
aggugauccuguauuuggg

SEQ ID NO: 3844 - RNA, 19 nt, Artificial Sequence
  Description of Artificial Sequence: Synthetic oligonucleotide
cccaaauacaggaucaccu

SEQ ID NO: 3845 - RNA, 19 nt, Artificial Sequence
  Description of Artificial Sequence: Synthetic oligonucleotide
ggugauccuguauuuggga

SEQ ID NO: 3846 - RNA, 19 nt, Artificial Sequence
  Description of Artificial Sequence: Synthetic oligonucleotide
ucccaaauacaggaucacc

SEQ ID NO: 3847 - RNA, 19 nt, Artificial Sequence
  Description of Artificial Sequence: Synthetic oligonucleotide
auccuguauuugggagguu

SEQ ID NO: 3848 - RNA, 19 nt, Artificial Sequence
  Description of Artificial Sequence: Synthetic oligonucleotide
aaccucccaaauacaggau

SEQ ID NO: 3849 - RNA, 19 nt, Artificial Sequence
  Description of Artificial Sequence: Synthetic oligonucleotide
uccuguauuugggagguua

SEQ ID NO: 3850 - RNA, 19 nt, Artificial Sequence
  Description of Artificial Sequence: Synthetic oligonucleotide
uaaccucccaaauacagga

SEQ ID NO: 3851 - RNA, 19 nt, Artificial Sequence
  Description of Artificial Sequence: Synthetic oligonucleotide
ccuguauuugggagguuaa

SEQ ID NO: 3852 - RNA, 19 nt, Artificial Sequence
  Description of Artificial Sequence: Synthetic oligonucleotide
uuaaccucccaaauacagg

SEQ ID NO: 3853 - RNA, 19 nt, Artificial Sequence
  Description of Artificial Sequence: Synthetic oligonucleotide
cuguauuugggagguuaac

SEQ ID NO: 3854 - RNA, 19 nt, Artificial Sequence
  Description of Artificial Sequence: Synthetic oligonucleotide
guuaaccucccaaauacag

SEQ ID NO: 3855 - RNA, 19 nt, Artificial Sequence
  Description of Artificial Sequence: Synthetic oligonucleotide
uguauuugggagguuaacu

SEQ ID NO: 3856 - RNA, 19 nt, Artificial Sequence
  Description of Artificial Sequence: Synthetic oligonucleotide
aguuaaccucccaaauaca

SEQ ID NO: 3857 - RNA, 19 nt, Artificial Sequence
  Description of Artificial Sequence: Synthetic oligonucleotide
guauuugggagguuaacuc

SEQ ID NO: 3858 - RNA, 19 nt, Artificial Sequence
  Description of Artificial Sequence: Synthetic oligonucleotide
gaguuaaccucccaaauac

SEQ ID NO: 3859 - RNA, 19 nt, Artificial Sequence
  Description of Artificial Sequence: Synthetic oligonucleotide
uauuugggagguuaacuca

SEQ ID NO: 3860 - RNA, 19 nt, Artificial Sequence
  Description of Artificial Sequence: Synthetic oligonucleotide
ugaguuaaccucccaaaua

SEQ ID NO: 3861 - RNA, 19 nt, Artificial Sequence
  Description of Artificial Sequence: Synthetic oligonucleotide
ggagguuaacucaggaagu

SEQ ID NO: 3862 - RNA, 19 nt, Artificial Sequence
  Description of Artificial Sequence: Synthetic oligonucleotide
acuuccugaguuaaccucc

SEQ ID NO: 3863 - RNA, 19 nt, Artificial Sequence
  Description of Artificial Sequence: Synthetic oligonucleotide
gagguuaacucaggaagug

SEQ ID NO: 3864 - RNA, 19 nt, Artificial Sequence
  Description of Artificial Sequence: Synthetic oligonucleotide
cacuuccugaguuaaccuc

SEQ ID NO: 3865 - RNA, 19 nt, Artificial Sequence
  Description of Artificial Sequence: Synthetic oligonucleotide
agguuaacucaggaaguga

SEQ ID NO: 3866 - RNA, 19 nt, Artificial Sequence
  Description of Artificial Sequence: Synthetic oligonucleotide
ucacuuccugaguuaaccu

SEQ ID NO: 3867 - RNA, 19 nt, Artificial Sequence
  Description of Artificial Sequence: Synthetic oligonucleotide
ucaggaagugagggcauaa

SEQ ID NO: 3868 - RNA, 19 nt, Artificial Sequence
  Description of Artificial Sequence: Synthetic oligonucleotide
uuaugcccucacuuccuga

SEQ ID NO: 3869 - RNA, 19 nt, Artificial Sequence
  Description of Artificial Sequence: Synthetic oligonucleotide
caggaagugagggcauaag

SEQ ID NO: 3870 - RNA, 19 nt, Artificial Sequence
  Description of Artificial Sequence: Synthetic oligonucleotide
cuuaugcccucacuuccug

SEQ ID NO: 3871 - RNA, 19 nt, Artificial Sequence
  Description of Artificial Sequence: Synthetic oligonucleotide
aggaagugagggcauaagg

SEQ ID NO: 3872 - RNA, 19 nt, Artificial Sequence
  Description of Artificial Sequence: Synthetic oligonucleotide
ccuuaugcccucacuuccu

SEQ ID NO: 3873 - RNA, 19 nt, Artificial Sequence
  Description of Artificial Sequence: Synthetic oligonucleotide
ggaagugagggcauaaggu

SEQ ID NO: 3874 - RNA, 19 nt, Artificial Sequence
  Description of Artificial Sequence: Synthetic oligonucleotide
accuuaugcccucacuucc

SEQ ID NO: 3875 - RNA, 19 nt, Artificial Sequence
  Description of Artificial Sequence: Synthetic oligonucleotide
gaagugagggcauaaggua

SEQ ID NO: 3876 - RNA, 19 nt, Artificial Sequence
  Description of Artificial Sequence: Synthetic oligonucleotide
uaccuuaugcccucacuuc

SEQ ID NO: 3877 - RNA, 19 nt, Artificial Sequence
  Description of Artificial Sequence: Synthetic oligonucleotide
aagugagggcauaagguaa

SEQ ID NO: 3878 - RNA, 19 nt, Artificial Sequence
  Description of Artificial Sequence: Synthetic oligonucleotide
uuaccuuaugcccucacuu

SEQ ID NO: 3879 - RNA, 19 nt, Artificial Sequence
  Description of Artificial Sequence: Synthetic oligonucleotide
agugagggcauaagguaaa

SEQ ID NO: 3880 - RNA, 19 nt, Artificial Sequence
  Description of Artificial Sequence: Synthetic oligonucleotide
uuuaccuuaugcccucacu

SEQ ID NO: 3881 - RNA, 19 nt, Artificial Sequence
  Description of Artificial Sequence: Synthetic oligonucleotide
aaagccauuaagaguaugu

SEQ ID NO: 3882 - RNA, 19 nt, Artificial Sequence
  Description of Artificial Sequence: Synthetic oligonucleotide
acauacucuuaauggcuuu

SEQ ID NO: 3883 - RNA, 19 nt, Artificial Sequence
  Description of Artificial Sequence: Synthetic oligonucleotide
aagccauuaagaguauguu

SEQ ID NO: 3884 - RNA, 19 nt, Artificial Sequence
  Description of Artificial Sequence: Synthetic oligonucleotide
aacauacucuuaauggcuu

SEQ ID NO: 3885 - RNA, 19 nt, Artificial Sequence
  Description of Artificial Sequence: Synthetic oligonucleotide
agccauuaagaguauguua

SEQ ID NO: 3886 - RNA, 19 nt, Artificial Sequence
  Description of Artificial Sequence: Synthetic oligonucleotide
uaacauacucuuaauggcu

SEQ ID NO: 3887 - RNA, 19 nt, Artificial Sequence
  Description of Artificial Sequence: Synthetic oligonucleotide
uaagaguauguuaaguccc

SEQ ID NO: 3888 - RNA, 19 nt, Artificial Sequence
  Description of Artificial Sequence: Synthetic oligonucleotide
gggacuuaacauacucuua

SEQ ID NO: 3889 - RNA, 19 nt, Artificial Sequence
  Description of Artificial Sequence: Synthetic oligonucleotide
aagaguauguuaagucccu

SEQ ID NO: 3890 - RNA, 19 nt, Artificial Sequence
  Description of Artificial Sequence: Synthetic oligonucleotide
agggacuuaacauacucuu

SEQ ID NO: 3891 - RNA, 19 nt, Artificial Sequence
  Description of Artificial Sequence: Synthetic oligonucleotide
agaguauguuaagucccuu

SEQ ID NO: 3892 - RNA, 19 nt, Artificial Sequence
  Description of Artificial Sequence: Synthetic oligonucleotide
aagggacuuaacauacucu

SEQ ID NO: 3893 - RNA, 19 nt, Artificial Sequence
  Description of Artificial Sequence: Synthetic oligonucleotide
gaguauguuaagucccuuc

SEQ ID NO: 3894 - RNA, 19 nt, Artificial Sequence
  Description of Artificial Sequence: Synthetic oligonucleotide
gaagggacuuaacauacuc

SEQ ID NO: 3895 - RNA, 19 nt, Artificial Sequence
  Description of Artificial Sequence: Synthetic oligonucleotide
aguauguuaagucccuuca

SEQ ID NO: 3896 - RNA, 19 nt, Artificial Sequence
  Description of Artificial Sequence: Synthetic oligonucleotide
ugaagggacuuaacauacu

SEQ ID NO: 3897 - RNA, 19 nt, Artificial Sequence
  Description of Artificial Sequence: Synthetic oligonucleotide
guauguuaagucccuucag

SEQ ID NO: 3898 - RNA, 19 nt, Artificial Sequence
  Description of Artificial Sequence: Synthetic oligonucleotide
cugaagggacuuaacauac

SEQ ID NO: 3899 - RNA, 19 nt, Artificial Sequence
  Description of Artificial Sequence: Synthetic oligonucleotide
uauguuaagucccuucagu

SEQ ID NO: 3900 - RNA, 19 nt, Artificial Sequence
  Description of Artificial Sequence: Synthetic oligonucleotide
acugaagggacuuaacaua

SEQ ID NO: 3901 - RNA, 19 nt, Artificial Sequence
  Description of Artificial Sequence: Synthetic oligonucleotide
auguuaagucccuucagua

SEQ ID NO: 3902 - RNA, 19 nt, Artificial Sequence
  Description of Artificial Sequence: Synthetic oligonucleotide
uacugaagggacuuaacau

SEQ ID NO: 3903 - RNA, 19 nt, Artificial Sequence
  Description of Artificial Sequence: Synthetic oligonucleotide
uguuaagucccuucaguag

SEQ ID NO: 3904 - RNA, 19 nt, Artificial Sequence
  Description of Artificial Sequence: Synthetic oligonucleotide
cuacugaagggacuuaaca

SEQ ID NO: 3905 - RNA, 19 nt, Artificial Sequence
  Description of Artificial Sequence: Synthetic oligonucleotide
guuaagucccuucaguagg

SEQ ID NO: 3906 - RNA, 19 nt, Artificial Sequence
  Description of Artificial Sequence: Synthetic oligonucleotide
ccuacugaagggacuuaac

SEQ ID NO: 3907 - RNA, 19 nt, Artificial Sequence
  Description of Artificial Sequence: Synthetic oligonucleotide
uuaagucccuucaguaggc

SEQ ID NO: 3908 - RNA, 19 nt, Artificial Sequence
  Description of Artificial Sequence: Synthetic oligonucleotide
gccuacugaagggacuuaa

SEQ ID NO: 3909 - RNA, 19 nt, Artificial Sequence
  Description of Artificial Sequence: Synthetic oligonucleotide
uaagucccuucaguaggcc

SEQ ID NO: 3910 - RNA, 19 nt, Artificial Sequence
  Description of Artificial Sequence: Synthetic oligonucleotide
ggccuacugaagggacuua

SEQ ID NO: 3911 - RNA, 19 nt, Artificial Sequence
  Description of Artificial Sequence: Synthetic oligonucleotide
aagucccuucaguaggccu

SEQ ID NO: 3912 - RNA, 19 nt, Artificial Sequence
  Description of Artificial Sequence: Synthetic oligonucleotide
aggccuacugaagggacuu

SEQ ID NO: 3913 - RNA, 19 nt, Artificial Sequence
  Description of Artificial Sequence: Synthetic oligonucleotide
agucccuucaguaggccuu

SEQ ID NO: 3914 - RNA, 19 nt, Artificial Sequence
  Description of Artificial Sequence: Synthetic oligonucleotide
aaggccuacugaagggacu

SEQ ID NO: 3915 - RNA, 19 nt, Artificial Sequence
  Description of Artificial Sequence: Synthetic oligonucleotide
gucccuucaguaggccuug

SEQ ID NO: 3916 - RNA, 19 nt, Artificial Sequence
  Description of Artificial Sequence: Synthetic oligonucleotide
caaggccuacugaagggac

SEQ ID NO: 3917 - RNA, 19 nt, Artificial Sequence
  Description of Artificial Sequence: Synthetic oligonucleotide
ucccuucaguaggccuugg

SEQ ID NO: 3918 - RNA, 19 nt, Artificial Sequence
  Description of Artificial Sequence: Synthetic oligonucleotide
ccaaggccuacugaaggga

SEQ ID NO: 3919 - RNA, 19 nt, Artificial Sequence
  Description of Artificial Sequence: Synthetic oligonucleotide
cccuucaguaggccuuggg

SEQ ID NO: 3920 - RNA, 19 nt, Artificial Sequence
  Description of Artificial Sequence: Synthetic oligonucleotide
cccaaggccuacugaaggg

SEQ ID NO: 3921 - RNA, 19 nt, Artificial Sequence
  Description of Artificial Sequence: Synthetic oligonucleotide
ccuucaguaggccuuggga

SEQ ID NO: 3922 - RNA, 19 nt, Artificial Sequence
  Description of Artificial Sequence: Synthetic oligonucleotide
ucccaaggccuacugaagg

SEQ ID NO: 3923 - RNA, 19 nt, Artificial Sequence
  Description of Artificial Sequence: Synthetic oligonucleotide
cuucaguaggccuugggaa

SEQ ID NO: 3924 - RNA, 19 nt, Artificial Sequence
  Description of Artificial Sequence: Synthetic oligonucleotide
uucccaaggccuacugaag

SEQ ID NO: 3925 - RNA, 19 nt, Artificial Sequence
  Description of Artificial Sequence: Synthetic oligonucleotide
aaaaguauagauugcccaa

SEQ ID NO: 3926 - RNA, 19 nt, Artificial Sequence
  Description of Artificial Sequence: Synthetic oligonucleotide
uugggcaaucuauacuuuu

SEQ ID NO: 3927 - RNA, 19 nt, Artificial Sequence
  Description of Artificial Sequence: Synthetic oligonucleotide
aaaguauagauugcccaag

SEQ ID NO: 3928 - RNA, 19 nt, Artificial Sequence
  Description of Artificial Sequence: Synthetic oligonucleotide
cuugggcaaucuauacuuu

SEQ ID NO: 3929 - RNA, 19 nt, Artificial Sequence
  Description of Artificial Sequence: Synthetic oligonucleotide
aaguauagauugcccaaga

SEQ ID NO: 3930 - RNA, 19 nt, Artificial Sequence
  Description of Artificial Sequence: Synthetic oligonucleotide
ucuugggcaaucuauacuu

SEQ ID NO: 3931 - RNA, 19 nt, Artificial Sequence
  Description of Artificial Sequence: Synthetic oligonucleotide
aaagacuggcagggugauc

SEQ ID NO: 3932 - RNA, 19 nt, Artificial Sequence
  Description of Artificial Sequence: Synthetic oligonucleotide
gaucacccugccagucuuu

SEQ ID NO: 3933 - RNA, 19 nt, Artificial Sequence
  Description of Artificial Sequence: Synthetic oligonucleotide
aagacuggcagggugauca

SEQ ID NO: 3934 - RNA, 19 nt, Artificial Sequence
  Description of Artificial Sequence: Synthetic oligonucleotide
ugaucacccugccagucuu

SEQ ID NO: 3935 - RNA, 19 nt, Artificial Sequence
  Description of Artificial Sequence: Synthetic oligonucleotide
cuggcagggugaucagucc

SEQ ID NO: 3936 - RNA, 19 nt, Artificial Sequence
  Description of Artificial Sequence: Synthetic oligonucleotide
ggacugaucacccugccag

SEQ ID NO: 3937 - RNA, 19 nt, Artificial Sequence
  Description of Artificial Sequence: Synthetic oligonucleotide
gaauguacuuaaugagugg

SEQ ID NO: 3938 - RNA, 19 nt, Artificial Sequence
  Description of Artificial Sequence: Synthetic oligonucleotide
ccacucauuaaguacauuc

SEQ ID NO: 3939 - RNA, 19 nt, Artificial Sequence
  Description of Artificial Sequence: Synthetic oligonucleotide
aauguacuuaaugaguggg

SEQ ID NO: 3940 - RNA, 19 nt, Artificial Sequence
  Description of Artificial Sequence: Synthetic oligonucleotide
cccacucauuaaguacauu

SEQ ID NO: 3941 - RNA, 19 nt, Artificial Sequence
  Description of Artificial Sequence: Synthetic oligonucleotide
uguacuuaaugagugggcu

SEQ ID NO: 3942 - RNA, 19 nt, Artificial Sequence
  Description of Artificial Sequence: Synthetic oligonucleotide
agcccacucauuaaguaca

SEQ ID NO: 3943 - RNA, 19 nt, Artificial Sequence
  Description of Artificial Sequence: Synthetic oligonucleotide
guacuuaaugagugggcua

SEQ ID NO: 3944 - RNA, 19 nt, Artificial Sequence
  Description of Artificial Sequence: Synthetic oligonucleotide
uagcccacucauuaaguac

SEQ ID NO: 3945 - RNA, 19 nt, Artificial Sequence
  Description of Artificial Sequence: Synthetic oligonucleotide
uacuuaaugagugggcuac

SEQ ID NO: 3946 - RNA, 19 nt, Artificial Sequence
  Description of Artificial Sequence: Synthetic oligonucleotide
guagcccacucauuaagua

SEQ ID NO: 3947 - RNA, 19 nt, Artificial Sequence
  Description of Artificial Sequence: Synthetic oligonucleotide
cuuaaugagugggcuacag

SEQ ID NO: 3948 - RNA, 19 nt, Artificial Sequence
  Description of Artificial Sequence: Synthetic oligonucleotide
cuguagcccacucauuaag

SEQ ID NO: 3949 - RNA, 19 nt, Artificial Sequence
  Description of Artificial Sequence: Synthetic oligonucleotide
uaaugagugggcuacagcg

SEQ ID NO: 3950 - RNA, 19 nt, Artificial Sequence
  Description of Artificial Sequence: Synthetic oligonucleotide
cgcuguagcccacucauua

SEQ ID NO: 3951 - RNA, 19 nt, Artificial Sequence
  Description of Artificial Sequence: Synthetic oligonucleotide
aaugagugggcuacagcgu

SEQ ID NO: 3952 - RNA, 19 nt, Artificial Sequence
  Description of Artificial Sequence: Synthetic oligonucleotide
acgcuguagcccacucauu

SEQ ID NO: 3953 - RNA, 19 nt, Artificial Sequence
  Description of Artificial Sequence: Synthetic oligonucleotide
augagugggcuacagcgua

SEQ ID NO: 3954 - RNA, 19 nt, Artificial Sequence
  Description of Artificial Sequence: Synthetic oligonucleotide
uacgcuguagcccacucau

SEQ ID NO: 3955 - RNA, 19 nt, Artificial Sequence
  Description of Artificial Sequence: Synthetic oligonucleotide
ugagugggcuacagcguau

SEQ ID NO: 3956 - RNA, 19 nt, Artificial Sequence
  Description of Artificial Sequence: Synthetic oligonucleotide
auacgcuguagcccacuca

SEQ ID NO: 3957 - RNA, 19 nt, Artificial Sequence
  Description of Artificial Sequence: Synthetic oligonucleotide
gagugggcuacagcguauc

SEQ ID NO: 3958 - RNA, 19 nt, Artificial Sequence
  Description of Artificial Sequence: Synthetic oligonucleotide
gauacgcuguagcccacuc

SEQ ID NO: 3959 - RNA, 19 nt, Artificial Sequence
  Description of Artificial Sequence: Synthetic oligonucleotide
agugggcuacagcguaucc

SEQ ID NO: 3960 - RNA, 19 nt, Artificial Sequence
  Description of Artificial Sequence: Synthetic oligonucleotide
ggauacgcuguagcccacu

SEQ ID NO: 3961 - RNA, 19 nt, Artificial Sequence
  Description of Artificial Sequence: Synthetic oligonucleotide
gugggcuacagcguauccu

SEQ ID NO: 3962 - RNA, 19 nt, Artificial Sequence
  Description of Artificial Sequence: Synthetic oligonucleotide
aggauacgcuguagcccac

SEQ ID NO: 3963 - RNA, 19 nt, Artificial Sequence
  Description of Artificial Sequence: Synthetic oligonucleotide
ugggcuacagcguauccuc

SEQ ID NO: 3964 - RNA, 19 nt, Artificial Sequence
  Description of Artificial Sequence: Synthetic oligonucleotide
gaggauacgcuguagccca

SEQ ID NO: 3965 - RNA, 19 nt, Artificial Sequence
  Description of Artificial Sequence: Synthetic oligonucleotide
agaguuguucuaccugggu

SEQ ID NO: 3966 - RNA, 19 nt, Artificial Sequence
  Description of Artificial Sequence: Synthetic oligonucleotide
acccagguagaacaacucu

SEQ ID NO: 3967 - RNA, 19 nt, Artificial Sequence
  Description of Artificial Sequence: Synthetic oligonucleotide
gaguuguucuaccugggua

SEQ ID NO: 3968 - RNA, 19 nt, Artificial Sequence
  Description of Artificial Sequence: Synthetic oligonucleotide
uacccagguagaacaacuc

SEQ ID NO: 3969 - RNA, 19 nt, Artificial Sequence
  Description of Artificial Sequence: Synthetic oligonucleotide
aguuguucuaccuggguau

SEQ ID NO: 3970 - RNA, 19 nt, Artificial Sequence
  Description of Artificial Sequence: Synthetic oligonucleotide
auacccagguagaacaacu

SEQ ID NO: 3971 - RNA, 19 nt, Artificial Sequence
  Description of Artificial Sequence: Synthetic oligonucleotide
guuguucuaccuggguaua

SEQ ID NO: 3972 - RNA, 19 nt, Artificial Sequence
  Description of Artificial Sequence: Synthetic oligonucleotide
uauacccagguagaacaac

SEQ ID NO: 3973 - RNA, 19 nt, Artificial Sequence
  Description of Artificial Sequence: Synthetic oligonucleotide
uuguucuaccuggguauau

SEQ ID NO: 3974 - RNA, 19 nt, Artificial Sequence
  Description of Artificial Sequence: Synthetic oligonucleotide
auauacccagguagaacaa

SEQ ID NO: 3975 - RNA, 19 nt, Artificial Sequence
  Description of Artificial Sequence: Synthetic oligonucleotide
uguucuaccuggguauauc

SEQ ID NO: 3976 - RNA, 19 nt, Artificial Sequence
  Description of Artificial Sequence: Synthetic oligonucleotide
gauauacccagguagaaca

SEQ ID NO: 3977 - RNA, 19 nt, Artificial Sequence
  Description of Artificial Sequence: Synthetic oligonucleotide
guucuaccuggguauaucc

SEQ ID NO: 3978 - RNA, 19 nt, Artificial Sequence
  Description of Artificial Sequence: Synthetic oligonucleotide
ggauauacccagguagaac

SEQ ID NO: 3979 - RNA, 19 nt, Artificial Sequence
  Description of Artificial Sequence: Synthetic oligonucleotide
uaccuggguauauccaaaa

SEQ ID NO: 3980 - RNA, 19 nt, Artificial Sequence
  Description of Artificial Sequence: Synthetic oligonucleotide
uuuuggauauacccaggua

SEQ ID NO: 3981 - RNA, 19 nt, Artificial Sequence
  Description of Artificial Sequence: Synthetic oligonucleotide
aggguauggaguuuacgag

SEQ ID NO: 3982 - RNA, 19 nt, Artificial Sequence
  Description of Artificial Sequence: Synthetic oligonucleotide
cucguaaacuccauacccu

SEQ ID NO: 3983 - RNA, 19 nt, Artificial Sequence
  Description of Artificial Sequence: Synthetic oligonucleotide
ggguauggaguuuacgagg

SEQ ID NO: 3984 - RNA, 19 nt, Artificial Sequence
  Description of Artificial Sequence: Synthetic oligonucleotide
ccucguaaacuccauaccc

SEQ ID NO: 3985 - RNA, 19 nt, Artificial Sequence
  Description of Artificial Sequence: Synthetic oligonucleotide
gguauggaguuuacgaggg

SEQ ID NO: 3986 - RNA, 19 nt, Artificial Sequence
  Description of Artificial Sequence: Synthetic oligonucleotide
cccucguaaacuccauacc

SEQ ID NO: 3987 - RNA, 19 nt, Artificial Sequence
  Description of Artificial Sequence: Synthetic oligonucleotide
guauggaguuuacgagggu

SEQ ID NO: 3988 - RNA, 19 nt, Artificial Sequence
  Description of Artificial Sequence: Synthetic oligonucleotide
acccucguaaacuccauac

SEQ ID NO: 3989 - RNA, 19 nt, Artificial Sequence
  Description of Artificial Sequence: Synthetic oligonucleotide
uauggaguuuacgaggguu

SEQ ID NO: 3990 - RNA, 19 nt, Artificial Sequence
  Description of Artificial Sequence: Synthetic oligonucleotide
aacccucguaaacuccaua

SEQ ID NO: 3991 - RNA, 19 nt, Artificial Sequence
  Description of Artificial Sequence: Synthetic oligonucleotide
auggaguuuacgaggguuc

SEQ ID NO: 3992 - RNA, 19 nt, Artificial Sequence
  Description of Artificial Sequence: Synthetic oligonucleotide
gaacccucguaaacuccau

SEQ ID NO: 3993 - RNA, 19 nt, Artificial Sequence
  Description of Artificial Sequence: Synthetic oligonucleotide
uggaguuuacgaggguuca

SEQ ID NO: 3994 - RNA, 19 nt, Artificial Sequence
  Description of Artificial Sequence: Synthetic oligonucleotide
ugaacccucguaaacucca

SEQ ID NO: 3995 - RNA, 19 nt, Artificial Sequence
  Description of Artificial Sequence: Synthetic oligonucleotide
ggaguuuacgaggguucaa

SEQ ID NO: 3996 - RNA, 19 nt, Artificial Sequence
  Description of Artificial Sequence: Synthetic oligonucleotide
uugaacccucguaaacucc

SEQ ID NO: 3997 - RNA, 19 nt, Artificial Sequence
  Description of Artificial Sequence: Synthetic oligonucleotide
gaguuuacgaggguucaag

SEQ ID NO: 3998 - RNA, 19 nt, Artificial Sequence
  Description of Artificial Sequence: Synthetic oligonucleotide
cuugaacccucguaaacuc

SEQ ID NO: 3999 - RNA, 19 nt, Artificial Sequence
  Description of Artificial Sequence: Synthetic oligonucleotide
aguuuacgaggguucaagg

SEQ ID NO: 4000 - RNA, 19 nt, Artificial Sequence
  Description of Artificial Sequence: Synthetic oligonucleotide
ccuugaacccucguaaacu

SEQ ID NO: 4001 - RNA, 19 nt, Artificial Sequence
  Description of Artificial Sequence: Synthetic oligonucleotide
guuuacgaggguucaaggu

SEQ ID NO: 4002 - RNA, 19 nt, Artificial Sequence
  Description of Artificial Sequence: Synthetic oligonucleotide
accuugaacccucguaaac

SEQ ID NO: 4003 - RNA, 19 nt, Artificial Sequence
  Description of Artificial Sequence: Synthetic oligonucleotide
uuuacgaggguucaaggua

SEQ ID NO: 4004 - RNA, 19 nt, Artificial Sequence
  Description of Artificial Sequence: Synthetic oligonucleotide
uaccuugaacccucguaaa

SEQ ID NO: 4005 - RNA, 19 nt, Artificial Sequence
  Description of Artificial Sequence: Synthetic oligonucleotide
cgaggguucaagguauuug

SEQ ID NO: 4006 - RNA, 19 nt, Artificial Sequence
  Description of Artificial Sequence: Synthetic oligonucleotide
caaauaccuugaacccucg

SEQ ID NO: 4007 - RNA, 19 nt, Artificial Sequence
  Description of Artificial Sequence: Synthetic oligonucleotide
gaggguucaagguauuugg

SEQ ID NO: 4008 - RNA, 19 nt, Artificial Sequence
  Description of Artificial Sequence: Synthetic oligonucleotide
ccaaauaccuugaacccuc

SEQ ID NO: 4009 - RNA, 19 nt, Artificial Sequence
  Description of Artificial Sequence: Synthetic oligonucleotide
aggguucaagguauuuggu

SEQ ID NO: 4010 - RNA, 19 nt, Artificial Sequence
  Description of Artificial Sequence: Synthetic oligonucleotide
accaaauaccuugaacccu

SEQ ID NO: 4011 - RNA, 19 nt, Artificial Sequence
  Description of Artificial Sequence: Synthetic oligonucleotide
ggguucaagguauuugguu

SEQ ID NO: 4012 - RNA, 19 nt, Artificial Sequence
  Description of Artificial Sequence: Synthetic oligonucleotide
aaccaaauaccuugaaccc

SEQ ID NO: 4013 - RNA, 19 nt, Artificial Sequence
  Description of Artificial Sequence: Synthetic oligonucleotide
gguucaagguauuugguuc

SEQ ID NO: 4014 - RNA, 19 nt, Artificial Sequence
  Description of Artificial Sequence: Synthetic oligonucleotide
gaaccaaauaccuugaacc

SEQ ID NO: 4015 - RNA, 19 nt, Artificial Sequence
  Description of Artificial Sequence: Synthetic oligonucleotide
guucaagguauuugguuca

SEQ ID NO: 4016 - RNA, 19 nt, Artificial Sequence
  Description of Artificial Sequence: Synthetic oligonucleotide
ugaaccaaauaccuugaac

SEQ ID NO: 4017 - RNA, 19 nt, Artificial Sequence
  Description of Artificial Sequence: Synthetic oligonucleotide
uucaagguauuugguucag

SEQ ID NO: 4018 - RNA, 19 nt, Artificial Sequence
  Description of Artificial Sequence: Synthetic oligonucleotide
cugaaccaaauaccuugaa

SEQ ID NO: 4019 - RNA, 19 nt, Artificial Sequence
  Description of Artificial Sequence: Synthetic oligonucleotide
ucaagguauuugguucagg

SEQ ID NO: 4020 - RNA, 19 nt, Artificial Sequence
  Description of Artificial Sequence: Synthetic oligonucleotide
ccugaaccaaauaccuuga

SEQ ID NO: 4021 - RNA, 19 nt, Artificial Sequence
  Description of Artificial Sequence: Synthetic oligonucleotide
caacuggccaggucacagg

SEQ ID NO: 4022 - RNA, 19 nt, Artificial Sequence
  Description of Artificial Sequence: Synthetic oligonucleotide
ccugugaccuggccaguug

SEQ ID NO: 4023 - RNA, 19 nt, Artificial Sequence
  Description of Artificial Sequence: Synthetic oligonucleotide
gccaggucacagggcaauc

SEQ ID NO: 4024 - RNA, 19 nt, Artificial Sequence
  Description of Artificial Sequence: Synthetic oligonucleotide
gauugcccugugaccuggc

SEQ ID NO: 4025 - RNA, 19 nt, Artificial Sequence
  Description of Artificial Sequence: Synthetic oligonucleotide
ccaggucacagggcaauca

SEQ ID NO: 4026 - RNA, 19 nt, Artificial Sequence
  Description of Artificial Sequence: Synthetic oligonucleotide
ugauugcccugugaccugg

SEQ ID NO: 4027 - RNA, 19 nt, Artificial Sequence
  Description of Artificial Sequence: Synthetic oligonucleotide
aggucacagggcaaucaag

SEQ ID NO: 4028 - RNA, 19 nt, Artificial Sequence
  Description of Artificial Sequence: Synthetic oligonucleotide
cuugauugcccugugaccu

SEQ ID NO: 4029 - RNA, 19 nt, Artificial Sequence
  Description of Artificial Sequence: Synthetic oligonucleotide
ggucacagggcaaucaagu

SEQ ID NO: 4030 - RNA, 19 nt, Artificial Sequence
  Description of Artificial Sequence: Synthetic oligonucleotide
acuugauugcccugugacc

SEQ ID NO: 4031 - RNA, 19 nt, Artificial Sequence
  Description of Artificial Sequence: Synthetic oligonucleotide
gucacagggcaaucaaguu

SEQ ID NO: 4032 - RNA, 19 nt, Artificial Sequence
  Description of Artificial Sequence: Synthetic oligonucleotide
aacuugauugcccugugac

SEQ ID NO: 4033 - RNA, 19 nt, Artificial Sequence
  Description of Artificial Sequence: Synthetic oligonucleotide
ucacagggcaaucaaguua

SEQ ID NO: 4034 - RNA, 19 nt, Artificial Sequence
  Description of Artificial Sequence: Synthetic oligonucleotide
uaacuugauugcccuguga

SEQ ID NO: 4035 - RNA, 19 nt, Artificial Sequence
  Description of Artificial Sequence: Synthetic oligonucleotide
cacagggcaaucaaguuac

SEQ ID NO: 4036 - RNA, 19 nt, Artificial Sequence
  Description of Artificial Sequence: Synthetic oligonucleotide
guaacuugauugcccugug

SEQ ID NO: 4037 - RNA, 19 nt, Artificial Sequence
  Description of Artificial Sequence: Synthetic oligonucleotide
acagggcaaucaaguuacu

SEQ ID NO: 4038 - RNA, 19 nt, Artificial Sequence
  Description of Artificial Sequence: Synthetic oligonucleotide
aguaacuugauugcccugu

SEQ ID NO: 4039 - RNA, 19 nt, Artificial Sequence
  Description of Artificial Sequence: Synthetic oligonucleotide
cagggcaaucaaguuacuc

SEQ ID NO: 4040 - RNA, 19 nt, Artificial Sequence
  Description of Artificial Sequence: Synthetic oligonucleotide
gaguaacuugauugcccug

SEQ ID NO: 4041 - RNA, 19 nt, Artificial Sequence
  Description of Artificial Sequence: Synthetic oligonucleotide
agggcaaucaaguuacucu

SEQ ID NO: 4042 - RNA, 19 nt, Artificial Sequence
  Description of Artificial Sequence: Synthetic oligonucleotide
agaguaacuugauugcccu

SEQ ID NO: 4043 - RNA, 19 nt, Artificial Sequence
  Description of Artificial Sequence: Synthetic oligonucleotide
caaucaaguuacucugugu

SEQ ID NO: 4044 - RNA, 19 nt, Artificial Sequence
  Description of Artificial Sequence: Synthetic oligonucleotide
acacagaguaacuugauug

SEQ ID NO: 4045 - RNA, 19 nt, Artificial Sequence
  Description of Artificial Sequence: Synthetic oligonucleotide
aaucaaguuacucuguguu

SEQ ID NO: 4046 - RNA, 19 nt, Artificial Sequence
  Description of Artificial Sequence: Synthetic oligonucleotide
aacacagaguaacuugauu

SEQ ID NO: 4047 - RNA, 19 nt, Artificial Sequence
  Description of Artificial Sequence: Synthetic oligonucleotide
aucaaguuacucuguguuu

SEQ ID NO: 4048 - RNA, 19 nt, Artificial Sequence
  Description of Artificial Sequence: Synthetic oligonucleotide
aaacacagaguaacuugau

SEQ ID NO: 4049 - RNA, 19 nt, Artificial Sequence
  Description of Artificial Sequence: Synthetic oligonucleotide
acucuguguuucuuuguca

SEQ ID NO: 4050 - RNA, 19 nt, Artificial Sequence
  Description of Artificial Sequence: Synthetic oligonucleotide
ugacaaagaaacacagagu

SEQ ID NO: 4051 - RNA, 19 nt, Artificial Sequence
  Description of Artificial Sequence: Synthetic oligonucleotide
ucuguguuucuuugucagg

SEQ ID NO: 4052 - RNA, 19 nt, Artificial Sequence
  Description of Artificial Sequence: Synthetic oligonucleotide
ccugacaaagaaacacaga

SEQ ID NO: 4053 - RNA, 19 nt, Artificial Sequence
  Description of Artificial Sequence: Synthetic oligonucleotide
uguuucuuugucaggacac

SEQ ID NO: 4054 - RNA, 19 nt, Artificial Sequence
  Description of Artificial Sequence: Synthetic oligonucleotide
guguccugacaaagaaaca

SEQ ID NO: 4055 - RNA, 19 nt, Artificial Sequence
  Description of Artificial Sequence: Synthetic oligonucleotide
aaagcagggauuguguuca

SEQ ID NO: 4056 - RNA, 19 nt, Artificial Sequence
  Description of Artificial Sequence: Synthetic oligonucleotide
ugaacacaaucccugcuuu

SEQ ID NO: 4057 - RNA, 19 nt, Artificial Sequence
  Description of Artificial Sequence: Synthetic oligonucleotide
aagcagggauuguguucau

SEQ ID NO: 4058 - RNA, 19 nt, Artificial Sequence
  Description of Artificial Sequence: Synthetic oligonucleotide
augaacacaaucccugcuu

SEQ ID NO: 4059 - RNA, 19 nt, Artificial Sequence
  Description of Artificial Sequence: Synthetic oligonucleotide
agcagggauuguguucauu

SEQ ID NO: 4060 - RNA, 19 nt, Artificial Sequence
  Description of Artificial Sequence: Synthetic oligonucleotide
aaugaacacaaucccugcu

SEQ ID NO: 4061 - RNA, 19 nt, Artificial Sequence
  Description of Artificial Sequence: Synthetic oligonucleotide
gcagggauuguguucauuu

SEQ ID NO: 4062 - RNA, 19 nt, Artificial Sequence
  Description of Artificial Sequence: Synthetic oligonucleotide
aaaugaacacaaucccugc

SEQ ID NO: 4063 - RNA, 19 nt, Artificial Sequence
  Description of Artificial Sequence: Synthetic oligonucleotide
cagggauuguguucauuug

SEQ ID NO: 4064 - RNA, 19 nt, Artificial Sequence
  Description of Artificial Sequence: Synthetic oligonucleotide
caaaugaacacaaucccug

SEQ ID NO: 4065 - RNA, 19 nt, Artificial Sequence
  Description of Artificial Sequence: Synthetic oligonucleotide
agggauuguguucauuuga

SEQ ID NO: 4066 - RNA, 19 nt, Artificial Sequence
  Description of Artificial Sequence: Synthetic oligonucleotide
ucaaaugaacacaaucccu

SEQ ID NO: 4067 - RNA, 19 nt, Artificial Sequence
  Description of Artificial Sequence: Synthetic oligonucleotide
guguucauuugaggguuuc

SEQ ID NO: 4068 - RNA, 19 nt, Artificial Sequence
  Description of Artificial Sequence: Synthetic oligonucleotide
gaaacccucaaaugaacac

SEQ ID NO: 4069 - RNA, 19 nt, Artificial Sequence
  Description of Artificial Sequence: Synthetic oligonucleotide
uguucauuugaggguuuca

SEQ ID NO: 4070 - RNA, 19 nt, Artificial Sequence
  Description of Artificial Sequence: Synthetic oligonucleotide
ugaaacccucaaaugaaca

SEQ ID NO: 4071 - RNA, 19 nt, Artificial Sequence
  Description of Artificial Sequence: Synthetic oligonucleotide
guucauuugaggguuucac

SEQ ID NO: 4072 - RNA, 19 nt, Artificial Sequence
  Description of Artificial Sequence: Synthetic oligonucleotide
gugaaacccucaaaugaac

SEQ ID NO: 4073 - RNA, 19 nt, Artificial Sequence
  Description of Artificial Sequence: Synthetic oligonucleotide
uucauuugaggguuucacu

SEQ ID NO: 4074 - RNA, 19 nt, Artificial Sequence
  Description of Artificial Sequence: Synthetic oligonucleotide
agugaaacccucaaaugaa

SEQ ID NO: 4075 - RNA, 19 nt, Artificial Sequence
  Description of Artificial Sequence: Synthetic oligonucleotide
ucauuugaggguuucacug

SEQ ID NO: 4076 - RNA, 19 nt, Artificial Sequence
  Description of Artificial Sequence: Synthetic oligonucleotide
cagugaaacccucaaauga

SEQ ID NO: 4077 - RNA, 19 nt, Artificial Sequence
  Description of Artificial Sequence: Synthetic oligonucleotide
cauuugaggguuucacugu

SEQ ID NO: 4078 - RNA, 19 nt, Artificial Sequence
  Description of Artificial Sequence: Synthetic oligonucleotide
acagugaaacccucaaaug

SEQ ID NO: 4079 - RNA, 19 nt, Artificial Sequence
  Description of Artificial Sequence: Synthetic oligonucleotide
agucucagcuuccaugcaa

SEQ ID NO: 4080 - RNA, 19 nt, Artificial Sequence
  Description of Artificial Sequence: Synthetic oligonucleotide
uugcauggaagcugagacu

SEQ ID NO: 4081 - RNA, 19 nt, Artificial Sequence
  Description of Artificial Sequence: Synthetic oligonucleotide
ucucagcuuccaugcaacu

SEQ ID NO: 4082 - RNA, 19 nt, Artificial Sequence
  Description of Artificial Sequence: Synthetic oligonucleotide
aguugcauggaagcugaga

SEQ ID NO: 4083 - RNA, 19 nt, Artificial Sequence
  Description of Artificial Sequence: Synthetic oligonucleotide
cucagcuuccaugcaacug

SEQ ID NO: 4084 - RNA, 19 nt, Artificial Sequence
  Description of Artificial Sequence: Synthetic oligonucleotide
caguugcauggaagcugag

SEQ ID NO: 4085 - RNA, 19 nt, Artificial Sequence
  Description of Artificial Sequence: Synthetic oligonucleotide
ucagcuuccaugcaacugu

SEQ ID NO: 4086 - RNA, 19 nt, Artificial Sequence
  Description of Artificial Sequence: Synthetic oligonucleotide
acaguugcauggaagcuga

SEQ ID NO: 4087 - RNA, 19 nt, Artificial Sequence
  Description of Artificial Sequence: Synthetic oligonucleotide
cagcuuccaugcaacuguc

SEQ ID NO: 4088 - RNA, 19 nt, Artificial Sequence
  Description of Artificial Sequence: Synthetic oligonucleotide
gacaguugcauggaagcug

SEQ ID NO: 4089 - RNA, 19 nt, Artificial Sequence
  Description of Artificial Sequence: Synthetic oligonucleotide
agcuuccaugcaacugucc

SEQ ID NO: 4090 - RNA, 19 nt, Artificial Sequence
  Description of Artificial Sequence: Synthetic oligonucleotide
ggacaguugcauggaagcu

SEQ ID NO: 4091 - RNA, 19 nt, Artificial Sequence
  Description of Artificial Sequence: Synthetic oligonucleotide
gcuuccaugcaacugucca

SEQ ID NO: 4092 - RNA, 19 nt, Artificial Sequence
  Description of Artificial Sequence: Synthetic oligonucleotide
uggacaguugcauggaagc

SEQ ID NO: 4093 - RNA, 19 nt, Artificial Sequence
  Description of Artificial Sequence: Synthetic oligonucleotide
cuuccaugcaacuguccau

SEQ ID NO: 4094 - RNA, 19 nt, Artificial Sequence
  Description of Artificial Sequence: Synthetic oligonucleotide
auggacaguugcauggaag

SEQ ID NO: 4095 - RNA, 19 nt, Artificial Sequence
  Description of Artificial Sequence: Synthetic oligonucleotide
uuccaugcaacuguccauc

SEQ ID NO: 4096 - RNA, 19 nt, Artificial Sequence
  Description of Artificial Sequence: Synthetic oligonucleotide
gauggacaguugcauggaa

SEQ ID NO: 4097 - RNA, 19 nt, Artificial Sequence
  Description of Artificial Sequence: Synthetic oligonucleotide
ccaugcaacuguccaucac

SEQ ID NO: 4098 - RNA, 19 nt, Artificial Sequence
  Description of Artificial Sequence: Synthetic oligonucleotide
gugauggacaguugcaugg

SEQ ID NO: 4099 - RNA, 19 nt, Artificial Sequence
  Description of Artificial Sequence: Synthetic oligonucleotide
caugcaacuguccaucacg

SEQ ID NO: 4100 - RNA, 19 nt, Artificial Sequence
  Description of Artificial Sequence: Synthetic oligonucleotide
cgugauggacaguugcaug

SEQ ID NO: 4101 - RNA, 19 nt, Artificial Sequence
  Description of Artificial Sequence: Synthetic oligonucleotide
augcaacuguccaucacgg

SEQ ID NO: 4102 - RNA, 19 nt, Artificial Sequence
  Description of Artificial Sequence: Synthetic oligonucleotide
ccgugauggacaguugcau

SEQ ID NO: 4103 - RNA, 19 nt, Artificial Sequence
  Description of Artificial Sequence: Synthetic oligonucleotide
ugcaacuguccaucacggc

SEQ ID NO: 4104 - RNA, 19 nt, Artificial Sequence
  Description of Artificial Sequence: Synthetic oligonucleotide
gccgugauggacaguugca

SEQ ID NO: 4105 - RNA, 19 nt, Artificial Sequence
  Description of Artificial Sequence: Synthetic oligonucleotide
gcaacuguccaucacggcu

SEQ ID NO: 4106 - RNA, 19 nt, Artificial Sequence
  Description of Artificial Sequence: Synthetic oligonucleotide
agccgugauggacaguugc

SEQ ID NO: 4107 - RNA, 19 nt, Artificial Sequence
  Description of Artificial Sequence: Synthetic oligonucleotide
caacuguccaucacggcug

SEQ ID NO: 4108 - RNA, 19 nt, Artificial Sequence
  Description of Artificial Sequence: Synthetic oligonucleotide
cagccgugauggacaguug

SEQ ID NO: 4109 - RNA, 19 nt, Artificial Sequence
  Description of Artificial Sequence: Synthetic oligonucleotide
aacuguccaucacggcugc

SEQ ID NO: 4110 - RNA, 19 nt, Artificial Sequence
  Description of Artificial Sequence: Synthetic oligonucleotide
gcagccgugauggacaguu

SEQ ID NO: 4111 - RNA, 19 nt, Artificial Sequence
  Description of Artificial Sequence: Synthetic oligonucleotide
acuguccaucacggcugca

SEQ ID NO: 4112 - RNA, 19 nt, Artificial Sequence
  Description of Artificial Sequence: Synthetic oligonucleotide
ugcagccgugauggacagu

SEQ ID NO: 4113 - RNA, 19 nt, Artificial Sequence
  Description of Artificial Sequence: Synthetic oligonucleotide
cuguccaucacggcugcaa

SEQ ID NO: 4114 - RNA, 19 nt, Artificial Sequence
  Description of Artificial Sequence: Synthetic oligonucleotide
uugcagccgugauggacag

SEQ ID NO: 4115 - RNA, 19 nt, Artificial Sequence
  Description of Artificial Sequence: Synthetic oligonucleotide
uguccaucacggcugcaac

SEQ ID NO: 4116 - RNA, 19 nt, Artificial Sequence
  Description of Artificial Sequence: Synthetic oligonucleotide
guugcagccgugauggaca

SEQ ID NO: 4117 - RNA, 19 nt, Artificial Sequence
  Description of Artificial Sequence: Synthetic oligonucleotide
guccaucacggcugcaacu

SEQ ID NO: 4118 - RNA, 19 nt, Artificial Sequence
  Description of Artificial Sequence: Synthetic oligonucleotide
aguugcagccgugauggac

SEQ ID NO: 4119 - RNA, 19 nt, Artificial Sequence
  Description of Artificial Sequence: Synthetic oligonucleotide
uccaucacggcugcaacug

SEQ ID NO: 4120 - RNA, 19 nt, Artificial Sequence
  Description of Artificial Sequence: Synthetic oligonucleotide
caguugcagccgugaugga

SEQ ID NO: 4121 - RNA, 19 nt, Artificial Sequence
  Description of Artificial Sequence: Synthetic oligonucleotide
ccaucacggcugcaacuga

SEQ ID NO: 4122 - RNA, 19 nt, Artificial Sequence
  Description of Artificial Sequence: Synthetic oligonucleotide
ucaguugcagccgugaugg

SEQ ID NO: 4123 - RNA, 19 nt, Artificial Sequence
  Description of Artificial Sequence: Synthetic oligonucleotide
caucacggcugcaacugaa

SEQ ID NO: 4124 - RNA, 19 nt, Artificial Sequence
  Description of Artificial Sequence: Synthetic oligonucleotide
uucaguugcagccgugaug

SEQ ID NO: 4125 - RNA, 19 nt, Artificial Sequence
  Description of Artificial Sequence: Synthetic oligonucleotide
acagcgcaccagaagcuaa

SEQ ID NO: 4126 - RNA, 19 nt, Artificial Sequence
  Description of Artificial Sequence: Synthetic oligonucleotide
uuagcuucuggugcgcugu

SEQ ID NO: 4127 - RNA, 19 nt, Artificial Sequence
  Description of Artificial Sequence: Synthetic oligonucleotide
cagcgcaccagaagcuaaa

SEQ ID NO: 4128 - RNA, 19 nt, Artificial Sequence
  Description of Artificial Sequence: Synthetic oligonucleotide
uuuagcuucuggugcgcug

SEQ ID NO: 4129 - RNA, 19 nt, Artificial Sequence
  Description of Artificial Sequence: Synthetic oligonucleotide
agcgcaccagaagcuaaag

SEQ ID NO: 4130 - RNA, 19 nt, Artificial Sequence
  Description of Artificial Sequence: Synthetic oligonucleotide
cuuuagcuucuggugcgcu

SEQ ID NO: 4131 - RNA, 19 nt, Artificial Sequence
  Description of Artificial Sequence: Synthetic oligonucleotide
gcgcaccagaagcuaaagu

SEQ ID NO: 4132 - RNA, 19 nt, Artificial Sequence
  Description of Artificial Sequence: Synthetic oligonucleotide
acuuuagcuucuggugcgc

SEQ ID NO: 4133 - RNA, 19 nt, Artificial Sequence
  Description of Artificial Sequence: Synthetic oligonucleotide
cgcaccagaagcuaaaguc

SEQ ID NO: 4134 - RNA, 19 nt, Artificial Sequence
  Description of Artificial Sequence: Synthetic oligonucleotide
gacuuuagcuucuggugcg

SEQ ID NO: 4135 - RNA, 19 nt, Artificial Sequence
  Description of Artificial Sequence: Synthetic oligonucleotide
gcaccagaagcuaaagucu

SEQ ID NO: 4136 - RNA, 19 nt, Artificial Sequence
  Description of Artificial Sequence: Synthetic oligonucleotide
agacuuuagcuucuggugc

SEQ ID NO: 4137 - RNA, 19 nt, Artificial Sequence
  Description of Artificial Sequence: Synthetic oligonucleotide
caccagaagcuaaagucuu

SEQ ID NO: 4138 - RNA, 19 nt, Artificial Sequence
  Description of Artificial Sequence: Synthetic oligonucleotide
aagacuuuagcuucuggug

SEQ ID NO: 4139 - RNA, 19 nt, Artificial Sequence
  Description of Artificial Sequence: Synthetic oligonucleotide
accagaagcuaaagucuug

SEQ ID NO: 4140 - RNA, 19 nt, Artificial Sequence
  Description of Artificial Sequence: Synthetic oligonucleotide
caagacuuuagcuucuggu

SEQ ID NO: 4141 - RNA, 19 nt, Artificial Sequence
  Description of Artificial Sequence: Synthetic oligonucleotide
ccagaagcuaaagucuuga

SEQ ID NO: 4142 - RNA, 19 nt, Artificial Sequence
  Description of Artificial Sequence: Synthetic oligonucleotide
ucaagacuuuagcuucugg

SEQ ID NO: 4143 - RNA, 19 nt, Artificial Sequence
  Description of Artificial Sequence: Synthetic oligonucleotide
cagaagcuaaagucuugau

SEQ ID NO: 4144 - RNA, 19 nt, Artificial Sequence
  Description of Artificial Sequence: Synthetic oligonucleotide
aucaagacuuuagcuucug

SEQ ID NO: 4145 - RNA, 19 nt, Artificial Sequence
  Description of Artificial Sequence: Synthetic oligonucleotide
agaagcuaaagucuugaug

SEQ ID NO: 4146 - RNA, 19 nt, Artificial Sequence
  Description of Artificial Sequence: Synthetic oligonucleotide
caucaagacuuuagcuucu

SEQ ID NO: 4147 - RNA, 19 nt, Artificial Sequence
  Description of Artificial Sequence: Synthetic oligonucleotide
gaagcuaaagucuugaugc

SEQ ID NO: 4148 - RNA, 19 nt, Artificial Sequence
  Description of Artificial Sequence: Synthetic oligonucleotide
gcaucaagacuuuagcuuc

SEQ ID NO: 4149 - RNA, 19 nt, Artificial Sequence
  Description of Artificial Sequence: Synthetic oligonucleotide
aagcuaaagucuugaugcc

SEQ ID NO: 4150 - RNA, 19 nt, Artificial Sequence
  Description of Artificial Sequence: Synthetic oligonucleotide
ggcaucaagacuuuagcuu

SEQ ID NO: 4151 - RNA, 19 nt, Artificial Sequence
  Description of Artificial Sequence: Synthetic oligonucleotide
agcuaaagucuugaugcca

SEQ ID NO: 4152 - RNA, 19 nt, Artificial Sequence
  Description of Artificial Sequence: Synthetic oligonucleotide
uggcaucaagacuuuagcu

SEQ ID NO: 4153 - RNA, 19 nt, Artificial Sequence
  Description of Artificial Sequence: Synthetic oligonucleotide
cccauucacaucucuguca

SEQ ID NO: 4154 - RNA, 19 nt, Artificial Sequence
  Description of Artificial Sequence: Synthetic oligonucleotide
ugacagagaugugaauggg

SEQ ID NO: 4155 - RNA, 19 nt, Artificial Sequence
  Description of Artificial Sequence: Synthetic oligonucleotide
uucacaucucugucacguc

SEQ ID NO: 4156 - RNA, 19 nt, Artificial Sequence
  Description of Artificial Sequence: Synthetic oligonucleotide
gacgugacagagaugugaa

SEQ ID NO: 4157 - RNA, 19 nt, Artificial Sequence
  Description of Artificial Sequence: Synthetic oligonucleotide
ucacaucucugucacgucc

SEQ ID NO: 4158 - RNA, 19 nt, Artificial Sequence
  Description of Artificial Sequence: Synthetic oligonucleotide
ggacgugacagagauguga

SEQ ID NO: 4159 - RNA, 19 nt, Artificial Sequence
  Description of Artificial Sequence: Synthetic oligonucleotide
cacaucucugucacgucca

SEQ ID NO: 4160 - RNA, 19 nt, Artificial Sequence
  Description of Artificial Sequence: Synthetic oligonucleotide
uggacgugacagagaugug

SEQ ID NO: 4161 - RNA, 19 nt, Artificial Sequence
  Description of Artificial Sequence: Synthetic oligonucleotide
ucucugucacguccacuaa

SEQ ID NO: 4162 - RNA, 19 nt, Artificial Sequence
  Description of Artificial Sequence: Synthetic oligonucleotide
uuaguggacgugacagaga

SEQ ID NO: 4163 - RNA, 19 nt, Artificial Sequence
  Description of Artificial Sequence: Synthetic oligonucleotide
cucugucacguccacuaau

SEQ ID NO: 4164 - RNA, 19 nt, Artificial Sequence
  Description of Artificial Sequence: Synthetic oligonucleotide
auuaguggacgugacagag

SEQ ID NO: 4165 - RNA, 19 nt, Artificial Sequence
  Description of Artificial Sequence: Synthetic oligonucleotide
ucugucacguccacuaauc

SEQ ID NO: 4166 - RNA, 19 nt, Artificial Sequence
  Description of Artificial Sequence: Synthetic oligonucleotide
gauuaguggacgugacaga

SEQ ID NO: 4167 - RNA, 19 nt, Artificial Sequence
  Description of Artificial Sequence: Synthetic oligonucleotide
cugucacguccacuaaucg

SEQ ID NO: 4168 - RNA, 19 nt, Artificial Sequence
  Description of Artificial Sequence: Synthetic oligonucleotide
cgauuaguggacgugacag

SEQ ID NO: 4169 - RNA, 19 nt, Artificial Sequence
  Description of Artificial Sequence: Synthetic oligonucleotide
ugucacguccacuaaucgg

SEQ ID NO: 4170 - RNA, 19 nt, Artificial Sequence
  Description of Artificial Sequence: Synthetic oligonucleotide
ccgauuaguggacgugaca

SEQ ID NO: 4171 - RNA, 19 nt, Artificial Sequence
  Description of Artificial Sequence: Synthetic oligonucleotide
gucacguccacuaaucggc

SEQ ID NO: 4172 - RNA, 19 nt, Artificial Sequence
  Description of Artificial Sequence: Synthetic oligonucleotide
gccgauuaguggacgugac

SEQ ID NO: 4173 - RNA, 19 nt, Artificial Sequence
  Description of Artificial Sequence: Synthetic oligonucleotide
ucacguccacuaaucggca

SEQ ID NO: 4174 - RNA, 19 nt, Artificial Sequence
  Description of Artificial Sequence: Synthetic oligonucleotide
ugccgauuaguggacguga

SEQ ID NO: 4175 - RNA, 19 nt, Artificial Sequence
  Description of Artificial Sequence: Synthetic oligonucleotide
cacguccacuaaucggcaa

SEQ ID NO: 4176 - RNA, 19 nt, Artificial Sequence
  Description of Artificial Sequence: Synthetic oligonucleotide
uugccgauuaguggacgug

SEQ ID NO: 4177 - RNA, 19 nt, Artificial Sequence
  Description of Artificial Sequence: Synthetic oligonucleotide
acguccacuaaucggcaaa

SEQ ID NO: 4178 - RNA, 19 nt, Artificial Sequence
  Description of Artificial Sequence: Synthetic oligonucleotide
uuugccgauuaguggacgu

SEQ ID NO: 4179 - RNA, 19 nt, Artificial Sequence
  Description of Artificial Sequence: Synthetic oligonucleotide
cguccacuaaucggcaaaa

SEQ ID NO: 4180 - RNA, 19 nt, Artificial Sequence
  Description of Artificial Sequence: Synthetic oligonucleotide
uuuugccgauuaguggacg

SEQ ID NO: 4181 - RNA, 19 nt, Artificial Sequence
  Description of Artificial Sequence: Synthetic oligonucleotide
guccacuaaucggcaaaag

SEQ ID NO: 4182 - RNA, 19 nt, Artificial Sequence
  Description of Artificial Sequence: Synthetic oligonucleotide
cuuuugccgauuaguggac

SEQ ID NO: 4183 - RNA, 19 nt, Artificial Sequence
  Description of Artificial Sequence: Synthetic oligonucleotide
uccacuaaucggcaaaagg

SEQ ID NO: 4184 - RNA, 19 nt, Artificial Sequence
  Description of Artificial Sequence: Synthetic oligonucleotide
ccuuuugccgauuagugga

SEQ ID NO: 4185 - RNA, 19 nt, Artificial Sequence
  Description of Artificial Sequence: Synthetic oligonucleotide
ccacuaaucggcaaaagga

SEQ ID NO: 4186 - RNA, 19 nt, Artificial Sequence
  Description of Artificial Sequence: Synthetic oligonucleotide
uccuuuugccgauuagugg

SEQ ID NO: 4187 - RNA, 19 nt, Artificial Sequence
  Description of Artificial Sequence: Synthetic oligonucleotide
cacuaaucggcaaaaggag

SEQ ID NO: 4188 - RNA, 19 nt, Artificial Sequence
  Description of Artificial Sequence: Synthetic oligonucleotide
cuccuuuugccgauuagug

SEQ ID NO: 4189 - RNA, 19 nt, Artificial Sequence
  Description of Artificial Sequence: Synthetic oligonucleotide
agaagaugaccuaagugug

SEQ ID NO: 4190 - RNA, 19 nt, Artificial Sequence
  Description of Artificial Sequence: Synthetic oligonucleotide
cacacuuaggucaucuucu

SEQ ID NO: 4191 - RNA, 19 nt, Artificial Sequence
  Description of Artificial Sequence: Synthetic oligonucleotide
gaagaugaccuaaguguga

SEQ ID NO: 4192 - RNA, 19 nt, Artificial Sequence
  Description of Artificial Sequence: Synthetic oligonucleotide
ucacacuuaggucaucuuc

SEQ ID NO: 4193 - RNA, 19 nt, Artificial Sequence
  Description of Artificial Sequence: Synthetic oligonucleotide
aagaugaccuaagugugac

SEQ ID NO: 4194 - RNA, 19 nt, Artificial Sequence
  Description of Artificial Sequence: Synthetic oligonucleotide
gucacacuuaggucaucuu

SEQ ID NO: 4195 - RNA, 19 nt, Artificial Sequence
  Description of Artificial Sequence: Synthetic oligonucleotide
agaugaccuaagugugacu

SEQ ID NO: 4196 - RNA, 19 nt, Artificial Sequence
  Description of Artificial Sequence: Synthetic oligonucleotide
agucacacuuaggucaucu

SEQ ID NO: 4197 - RNA, 19 nt, Artificial Sequence
  Description of Artificial Sequence: Synthetic oligonucleotide
gaugaccuaagugugacug

SEQ ID NO: 4198 - RNA, 19 nt, Artificial Sequence
  Description of Artificial Sequence: Synthetic oligonucleotide
cagucacacuuaggucauc

SEQ ID NO: 4199 - RNA, 19 nt, Artificial Sequence
  Description of Artificial Sequence: Synthetic oligonucleotide
augaccuaagugugacugc

SEQ ID NO: 4200 - RNA, 19 nt, Artificial Sequence
  Description of Artificial Sequence: Synthetic oligonucleotide
gcagucacacuuaggucau

SEQ ID NO: 4201 - RNA, 19 nt, Artificial Sequence
  Description of Artificial Sequence: Synthetic oligonucleotide
ugaccuaagugugacugca

SEQ ID NO: 4202 - RNA, 19 nt, Artificial Sequence
  Description of Artificial Sequence: Synthetic oligonucleotide
ugcagucacacuuagguca

SEQ ID NO: 4203 - RNA, 19 nt, Artificial Sequence
  Description of Artificial Sequence: Synthetic oligonucleotide
aaaaugaagccagagcagu

SEQ ID NO: 4204 - RNA, 19 nt, Artificial Sequence
  Description of Artificial Sequence: Synthetic oligonucleotide
acugcucuggcuucauuuu

SEQ ID NO: 4205 - RNA, 19 nt, Artificial Sequence
  Description of Artificial Sequence: Synthetic oligonucleotide
uccgaccaaggaggaagga

SEQ ID NO: 4206 - RNA, 19 nt, Artificial Sequence
  Description of Artificial Sequence: Synthetic oligonucleotide
uccuuccuccuuggucgga

SEQ ID NO: 4207 - RNA, 19 nt, Artificial Sequence
  Description of Artificial Sequence: Synthetic oligonucleotide
ccgaccaaggaggaaggaa

SEQ ID NO: 4208 - RNA, 19 nt, Artificial Sequence
  Description of Artificial Sequence: Synthetic oligonucleotide
uuccuuccuccuuggucgg

SEQ ID NO: 4209 - RNA, 19 nt, Artificial Sequence
  Description of Artificial Sequence: Synthetic oligonucleotide
agagcagguaagcaggaag

SEQ ID NO: 4210 - RNA, 19 nt, Artificial Sequence
  Description of Artificial Sequence: Synthetic oligonucleotide
cuuccugcuuaccugcucu

SEQ ID NO: 4211 - RNA, 19 nt, Artificial Sequence
  Description of Artificial Sequence: Synthetic oligonucleotide
gagcagguaagcaggaagg

SEQ ID NO: 4212 - RNA, 19 nt, Artificial Sequence
  Description of Artificial Sequence: Synthetic oligonucleotide
ccuuccugcuuaccugcuc

SEQ ID NO: 4213 - RNA, 19 nt, Artificial Sequence
  Description of Artificial Sequence: Synthetic oligonucleotide
agguaagcaggaaggccag

SEQ ID NO: 4214 - RNA, 19 nt, Artificial Sequence
  Description of Artificial Sequence: Synthetic oligonucleotide
cuggccuuccugcuuaccu

SEQ ID NO: 4215 - RNA, 19 nt, Artificial Sequence
  Description of Artificial Sequence: Synthetic oligonucleotide
agcaggaaggccagugucc

SEQ ID NO: 4216 - RNA, 19 nt, Artificial Sequence
  Description of Artificial Sequence: Synthetic oligonucleotide
ggacacuggccuuccugcu

SEQ ID NO: 4217 - RNA, 19 nt, Artificial Sequence
  Description of Artificial Sequence: Synthetic oligonucleotide
caggaaggccaguguccca

SEQ ID NO: 4218 - RNA, 19 nt, Artificial Sequence
  Description of Artificial Sequence: Synthetic oligonucleotide
ugggacacuggccuuccug

SEQ ID NO: 4219 - RNA, 19 nt, Artificial Sequence
  Description of Artificial Sequence: Synthetic oligonucleotide
ucccagacaggacccuaau

SEQ ID NO: 4220 - RNA, 19 nt, Artificial Sequence
  Description of Artificial Sequence: Synthetic oligonucleotide
auuaggguccugucuggga

SEQ ID NO: 4221 - RNA, 19 nt, Artificial Sequence
  Description of Artificial Sequence: Synthetic oligonucleotide
cccagacaggacccuaaug

SEQ ID NO: 4222 - RNA, 19 nt, Artificial Sequence
  Description of Artificial Sequence: Synthetic oligonucleotide
cauuaggguccugucuggg

SEQ ID NO: 4223 - RNA, 19 nt, Artificial Sequence
  Description of Artificial Sequence: Synthetic oligonucleotide
ccagacaggacccuaauga

SEQ ID NO: 4224 - RNA, 19 nt, Artificial Sequence
  Description of Artificial Sequence: Synthetic oligonucleotide
ucauuaggguccugucugg

SEQ ID NO: 4225 - RNA, 19 nt, Artificial Sequence
  Description of Artificial Sequence: Synthetic oligonucleotide
cagacaggacccuaaugau

SEQ ID NO: 4226 - RNA, 19 nt, Artificial Sequence
  Description of Artificial Sequence: Synthetic oligonucleotide
aucauuaggguccugucug

SEQ ID NO: 4227 - RNA, 19 nt, Artificial Sequence
  Description of Artificial Sequence: Synthetic oligonucleotide
agacaggacccuaaugauc

SEQ ID NO: 4228 - RNA, 19 nt, Artificial Sequence
  Description of Artificial Sequence: Synthetic oligonucleotide
gaucauuaggguccugucu

SEQ ID NO: 4229 - RNA, 19 nt, Artificial Sequence
  Description of Artificial Sequence: Synthetic oligonucleotide
gacaggacccuaaugaucc

SEQ ID NO: 4230 - RNA, 19 nt, Artificial Sequence
  Description of Artificial Sequence: Synthetic oligonucleotide
ggaucauuaggguccuguc

SEQ ID NO: 4231 - RNA, 19 nt, Artificial Sequence
  Description of Artificial Sequence: Synthetic oligonucleotide
ggacccuaaugauccugaa

SEQ ID NO: 4232 - RNA, 19 nt, Artificial Sequence
  Description of Artificial Sequence: Synthetic oligonucleotide
uucaggaucauuagggucc

SEQ ID NO: 4233 - RNA, 19 nt, Artificial Sequence
  Description of Artificial Sequence: Synthetic oligonucleotide
ccuaaugauccugaaucca

SEQ ID NO: 4234 - RNA, 19 nt, Artificial Sequence
  Description of Artificial Sequence: Synthetic oligonucleotide
uggauucaggaucauuagg

SEQ ID NO: 4235 - RNA, 19 nt, Artificial Sequence
  Description of Artificial Sequence: Synthetic oligonucleotide
cuaaugauccugaauccau

SEQ ID NO: 4236 - RNA, 19 nt, Artificial Sequence
  Description of Artificial Sequence: Synthetic oligonucleotide
auggauucaggaucauuag

SEQ ID NO: 4237 - RNA, 19 nt, Artificial Sequence
  Description of Artificial Sequence: Synthetic oligonucleotide
ugauccugaauccauguau

SEQ ID NO: 4238 - RNA, 19 nt, Artificial Sequence
  Description of Artificial Sequence: Synthetic oligonucleotide
auacauggauucaggauca

SEQ ID NO: 4239 - RNA, 19 nt, Artificial Sequence
  Description of Artificial Sequence: Synthetic oligonucleotide
gauccugaauccauguauc

SEQ ID NO: 4240 - RNA, 19 nt, Artificial Sequence
  Description of Artificial Sequence: Synthetic oligonucleotide
gauacauggauucaggauc

SEQ ID NO: 4241 - RNA, 19 nt, Artificial Sequence
  Description of Artificial Sequence: Synthetic oligonucleotide
auccugaauccauguauca

SEQ ID NO: 4242 - RNA, 19 nt, Artificial Sequence
  Description of Artificial Sequence: Synthetic oligonucleotide
ugauacauggauucaggau

SEQ ID NO: 4243 - RNA, 19 nt, Artificial Sequence
  Description of Artificial Sequence: Synthetic oligonucleotide
uccauguaucaggauccau

SEQ ID NO: 4244 - RNA, 19 nt, Artificial Sequence
  Description of Artificial Sequence: Synthetic oligonucleotide
auggauccugauacaugga

SEQ ID NO: 4245 - RNA, 19 nt, Artificial Sequence
  Description of Artificial Sequence: Synthetic oligonucleotide
ccauguaucaggauccauc

SEQ ID NO: 4246 - RNA, 19 nt, Artificial Sequence
  Description of Artificial Sequence: Synthetic oligonucleotide
gauggauccugauacaugg

SEQ ID NO: 4247 - RNA, 19 nt, Artificial Sequence
  Description of Artificial Sequence: Synthetic oligonucleotide
cauguaucaggauccaucc

SEQ ID NO: 4248 - RNA, 19 nt, Artificial Sequence
  Description of Artificial Sequence: Synthetic oligonucleotide
ggauggauccugauacaug

SEQ ID NO: 4249 - RNA, 19 nt, Artificial Sequence
  Description of Artificial Sequence: Synthetic oligonucleotide
ucaccucucauuuuccaaa

SEQ ID NO: 4250 - RNA, 19 nt, Artificial Sequence
  Description of Artificial Sequence: Synthetic oligonucleotide
uuuggaaaaugagagguga

SEQ ID NO: 4251 - RNA, 19 nt, Artificial Sequence
  Description of Artificial Sequence: Synthetic oligonucleotide
uccaaagcccugccaugcu

SEQ ID NO: 4252 - RNA, 19 nt, Artificial Sequence
  Description of Artificial Sequence: Synthetic oligonucleotide
agcauggcagggcuuugga

SEQ ID NO: 4253 - RNA, 19 nt, Artificial Sequence
  Description of Artificial Sequence: Synthetic oligonucleotide
ccaaagcccugccaugcug

SEQ ID NO: 4254 - RNA, 19 nt, Artificial Sequence
  Description of Artificial Sequence: Synthetic oligonucleotide
cagcauggcagggcuuugg

SEQ ID NO: 4255 - RNA, 19 nt, Artificial Sequence
  Description of Artificial Sequence: Synthetic oligonucleotide
caugcugccaucccacuuc

SEQ ID NO: 4256 - RNA, 19 nt, Artificial Sequence
  Description of Artificial Sequence: Synthetic oligonucleotide
gaagugggauggcagcaug

SEQ ID NO: 4257 - RNA, 19 nt, Artificial Sequence
  Description of Artificial Sequence: Synthetic oligonucleotide
augcugccaucccacuucc

SEQ ID NO: 4258 - RNA, 19 nt, Artificial Sequence
  Description of Artificial Sequence: Synthetic oligonucleotide
ggaagugggauggcagcau

SEQ ID NO: 4259 - RNA, 19 nt, Artificial Sequence
  Description of Artificial Sequence: Synthetic oligonucleotide
ugcugccaucccacuuccc

SEQ ID NO: 4260 - RNA, 19 nt, Artificial Sequence
  Description of Artificial Sequence: Synthetic oligonucleotide
gggaagugggauggcagca

SEQ ID NO: 4261 - RNA, 19 nt, Artificial Sequence
  Description of Artificial Sequence: Synthetic oligonucleotide
cggguucccuuuuccuaaa

SEQ ID NO: 4262 - RNA, 19 nt, Artificial Sequence
  Description of Artificial Sequence: Synthetic oligonucleotide
uuuaggaaaagggaacccg

SEQ ID NO: 4263 - RNA, 19 nt, Artificial Sequence
  Description of Artificial Sequence: Synthetic oligonucleotide
agcugcagcuuauggcuuc

SEQ ID NO: 4264 - RNA, 19 nt, Artificial Sequence
  Description of Artificial Sequence: Synthetic oligonucleotide
gaagccauaagcugcagcu

SEQ ID NO: 4265 - RNA, 19 nt, Artificial Sequence
  Description of Artificial Sequence: Synthetic oligonucleotide
gcugcagcuuauggcuucu

SEQ ID NO: 4266 - RNA, 19 nt, Artificial Sequence
  Description of Artificial Sequence: Synthetic oligonucleotide
agaagccauaagcugcagc

SEQ ID NO: 4267 - RNA, 19 nt, Artificial Sequence
  Description of Artificial Sequence: Synthetic oligonucleotide
cugcagcuuauggcuucuc

SEQ ID NO: 4268 - RNA, 19 nt, Artificial Sequence
  Description of Artificial Sequence: Synthetic oligonucleotide
gagaagccauaagcugcag

SEQ ID NO: 4269 - RNA, 19 nt, Artificial Sequence
  Description of Artificial Sequence: Synthetic oligonucleotide
ugcagcuuauggcuucucc

SEQ ID NO: 4270 - RNA, 19 nt, Artificial Sequence
  Description of Artificial Sequence: Synthetic oligonucleotide
ggagaagccauaagcugca

SEQ ID NO: 4271 - RNA, 19 nt, Artificial Sequence
  Description of Artificial Sequence: Synthetic oligonucleotide
gcagcuuauggcuucucca

SEQ ID NO: 4272 - RNA, 19 nt, Artificial Sequence
  Description of Artificial Sequence: Synthetic oligonucleotide
uggagaagccauaagcugc

SEQ ID NO: 4273 - RNA, 19 nt, Artificial Sequence
  Description of Artificial Sequence: Synthetic oligonucleotide
cagcuuauggcuucuccag

SEQ ID NO: 4274 - RNA, 19 nt, Artificial Sequence
  Description of Artificial Sequence: Synthetic oligonucleotide
cuggagaagccauaagcug

SEQ ID NO: 4275 - RNA, 19 nt, Artificial Sequence
  Description of Artificial Sequence: Synthetic oligonucleotide
agcuuauggcuucuccagu

SEQ ID NO: 4276 - RNA, 19 nt, Artificial Sequence
  Description of Artificial Sequence: Synthetic oligonucleotide
acuggagaagccauaagcu

SEQ ID NO: 4277 - RNA, 19 nt, Artificial Sequence
  Description of Artificial Sequence: Synthetic oligonucleotide
gcuuauggcuucuccagua

SEQ ID NO: 4278 - RNA, 19 nt, Artificial Sequence
  Description of Artificial Sequence: Synthetic oligonucleotide
uacuggagaagccauaagc

SEQ ID NO: 4279 - RNA, 19 nt, Artificial Sequence
  Description of Artificial Sequence: Synthetic oligonucleotide
cuuauggcuucuccaguag

SEQ ID NO: 4280 - RNA, 19 nt, Artificial Sequence
  Description of Artificial Sequence: Synthetic oligonucleotide
cuacuggagaagccauaag

SEQ ID NO: 4281 - RNA, 19 nt, Artificial Sequence
  Description of Artificial Sequence: Synthetic oligonucleotide
uuauggcuucuccaguagg

SEQ ID NO: 4282 - RNA, 19 nt, Artificial Sequence
  Description of Artificial Sequence: Synthetic oligonucleotide
ccuacuggagaagccauaa

SEQ ID NO: 4283 - RNA, 19 nt, Artificial Sequence
  Description of Artificial Sequence: Synthetic oligonucleotide
uauggcuucuccaguaggu

SEQ ID NO: 4284 - RNA, 19 nt, Artificial Sequence
  Description of Artificial Sequence: Synthetic oligonucleotide
accuacuggagaagccaua

SEQ ID NO: 4285 - RNA, 19 nt, Artificial Sequence
  Description of Artificial Sequence: Synthetic oligonucleotide
auggcuucuccaguaggug

SEQ ID NO: 4286 - RNA, 19 nt, Artificial Sequence
  Description of Artificial Sequence: Synthetic oligonucleotide
caccuacuggagaagccau

SEQ ID NO: 4287 - RNA, 19 nt, Artificial Sequence
  Description of Artificial Sequence: Synthetic oligonucleotide
uggcuucuccaguaggugg

SEQ ID NO: 4288 - RNA, 19 nt, Artificial Sequence
  Description of Artificial Sequence: Synthetic oligonucleotide
ccaccuacuggagaagcca

SEQ ID NO: 4289 - RNA, 19 nt, Artificial Sequence
  Description of Artificial Sequence: Synthetic oligonucleotide
ggcuucuccaguagguggc

SEQ ID NO: 4290 - RNA, 19 nt, Artificial Sequence
  Description of Artificial Sequence: Synthetic oligonucleotide
gccaccuacuggagaagcc

SEQ ID NO: 4291 - RNA, 19 nt, Artificial Sequence
  Description of Artificial Sequence: Synthetic oligonucleotide
gcuucuccaguagguggca

SEQ ID NO: 4292 - RNA, 19 nt, Artificial Sequence
  Description of Artificial Sequence: Synthetic oligonucleotide
ugccaccuacuggagaagc

SEQ ID NO: 4293 - RNA, 19 nt, Artificial Sequence
  Description of Artificial Sequence: Synthetic oligonucleotide
cuucuccaguagguggcag

SEQ ID NO: 4294 - RNA, 19 nt, Artificial Sequence
  Description of Artificial Sequence: Synthetic oligonucleotide
cugccaccuacuggagaag

SEQ ID NO: 4295 - RNA, 19 nt, Artificial Sequence
  Description of Artificial Sequence: Synthetic oligonucleotide
uucuccaguagguggcagc

SEQ ID NO: 4296 - RNA, 19 nt, Artificial Sequence
  Description of Artificial Sequence: Synthetic oligonucleotide
gcugccaccuacuggagaa

SEQ ID NO: 4297 - RNA, 19 nt, Artificial Sequence
  Description of Artificial Sequence: Synthetic oligonucleotide
ucuccaguagguggcagca

SEQ ID NO: 4298 - RNA, 19 nt, Artificial Sequence
  Description of Artificial Sequence: Synthetic oligonucleotide
ugcugccaccuacuggaga

SEQ ID NO: 4299 - RNA, 19 nt, Artificial Sequence
  Description of Artificial Sequence: Synthetic oligonucleotide
cuccaguagguggcagcac

SEQ ID NO: 4300 - RNA, 19 nt, Artificial Sequence
  Description of Artificial Sequence: Synthetic oligonucleotide
gugcugccaccuacuggag

SEQ ID NO: 4301 - RNA, 19 nt, Artificial Sequence
  Description of Artificial Sequence: Synthetic oligonucleotide
acaccagaagucacauuuc

SEQ ID NO: 4302 - RNA, 19 nt, Artificial Sequence
  Description of Artificial Sequence: Synthetic oligonucleotide
gaaaugugacuucuggugu

SEQ ID NO: 4303 - RNA, 19 nt, Artificial Sequence
  Description of Artificial Sequence: Synthetic oligonucleotide
gaagucacauuucauccuu

SEQ ID NO: 4304 - RNA, 19 nt, Artificial Sequence
  Description of Artificial Sequence: Synthetic oligonucleotide
aaggaugaaaugugacuuc

SEQ ID NO: 4305 - RNA, 19 nt, Artificial Sequence
  Description of Artificial Sequence: Synthetic oligonucleotide
aagucacauuucauccuuu

SEQ ID NO: 4306 - RNA, 19 nt, Artificial Sequence
  Description of Artificial Sequence: Synthetic oligonucleotide
aaaggaugaaaugugacuu

SEQ ID NO: 4307 - RNA, 19 nt, Artificial Sequence
  Description of Artificial Sequence: Synthetic oligonucleotide
agucacauuucauccuuuu

SEQ ID NO: 4308 - RNA, 19 nt, Artificial Sequence
  Description of Artificial Sequence: Synthetic oligonucleotide
aaaaggaugaaaugugacu

SEQ ID NO: 4309 - RNA, 19 nt, Artificial Sequence
  Description of Artificial Sequence: Synthetic oligonucleotide
uuucauccuuuuacauggu

SEQ ID NO: 4310 - RNA, 19 nt, Artificial Sequence
  Description of Artificial Sequence: Synthetic oligonucleotide
accauguaaaaggaugaaa

SEQ ID NO: 4311 - RNA, 19 nt, Artificial Sequence
  Description of Artificial Sequence: Synthetic oligonucleotide
uucauccuuuuacaugguu

SEQ ID NO: 4312 - RNA, 19 nt, Artificial Sequence
  Description of Artificial Sequence: Synthetic oligonucleotide
aaccauguaaaaggaugaa

SEQ ID NO: 4313 - RNA, 19 nt, Artificial Sequence
  Description of Artificial Sequence: Synthetic oligonucleotide
ucauccuuuuacaugguuc

SEQ ID NO: 4314 - RNA, 19 nt, Artificial Sequence
  Description of Artificial Sequence: Synthetic oligonucleotide
gaaccauguaaaaggauga

SEQ ID NO: 4315 - RNA, 19 nt, Artificial Sequence
  Description of Artificial Sequence: Synthetic oligonucleotide
cauccuuuuacaugguucc

SEQ ID NO: 4316 - RNA, 19 nt, Artificial Sequence
  Description of Artificial Sequence: Synthetic oligonucleotide
ggaaccauguaaaaggaug

SEQ ID NO: 4317 - RNA, 19 nt, Artificial Sequence
  Description of Artificial Sequence: Synthetic oligonucleotide
ugguucccaucuacccuca

SEQ ID NO: 4318 - RNA, 19 nt, Artificial Sequence
  Description of Artificial Sequence: Synthetic oligonucleotide
ugaggguagaugggaacca

SEQ ID NO: 4319 - RNA, 19 nt, Artificial Sequence
  Description of Artificial Sequence: Synthetic oligonucleotide
gguucccaucuacccucac

SEQ ID NO: 4320 - RNA, 19 nt, Artificial Sequence
  Description of Artificial Sequence: Synthetic oligonucleotide
gugaggguagaugggaacc

SEQ ID NO: 4321 - RNA, 19 nt, Artificial Sequence
  Description of Artificial Sequence: Synthetic oligonucleotide
guucccaucuacccucaca

SEQ ID NO: 4322 - RNA, 19 nt, Artificial Sequence
  Description of Artificial Sequence: Synthetic oligonucleotide
ugugaggguagaugggaac

SEQ ID NO: 4323 - RNA, 19 nt, Artificial Sequence
  Description of Artificial Sequence: Synthetic oligonucleotide
ggcaauucuuccuccagga

SEQ ID NO: 4324 - RNA, 19 nt, Artificial Sequence
  Description of Artificial Sequence: Synthetic oligonucleotide
uccuggaggaagaauugcc

SEQ ID NO: 4325 - RNA, 19 nt, Artificial Sequence
  Description of Artificial Sequence: Synthetic oligonucleotide
gcaauucuuccuccaggac

SEQ ID NO: 4326 - RNA, 19 nt, Artificial Sequence
  Description of Artificial Sequence: Synthetic oligonucleotide
guccuggaggaagaauugc

SEQ ID NO: 4327 - RNA, 19 nt, Artificial Sequence
  Description of Artificial Sequence: Synthetic oligonucleotide
caauucuuccuccaggacc

SEQ ID NO: 4328 - RNA, 19 nt, Artificial Sequence
  Description of Artificial Sequence: Synthetic oligonucleotide
gguccuggaggaagaauug

SEQ ID NO: 4329 - RNA, 19 nt, Artificial Sequence
  Description of Artificial Sequence: Synthetic oligonucleotide
aauucuuccuccaggaccc

SEQ ID NO: 4330 - RNA, 19 nt, Artificial Sequence
  Description of Artificial Sequence: Synthetic oligonucleotide
ggguccuggaggaagaauu

SEQ ID NO: 4331 - RNA, 19 nt, Artificial Sequence
  Description of Artificial Sequence: Synthetic oligonucleotide
cccuuggacuuugcccuuc

SEQ ID NO: 4332 - RNA, 19 nt, Artificial Sequence
  Description of Artificial Sequence: Synthetic oligonucleotide
gaagggcaaaguccaaggg

SEQ ID NO: 4333 - RNA, 19 nt, Artificial Sequence
  Description of Artificial Sequence: Synthetic oligonucleotide
ccuuggacuuugcccuucu

SEQ ID NO: 4334 - RNA, 19 nt, Artificial Sequence
  Description of Artificial Sequence: Synthetic oligonucleotide
agaagggcaaaguccaagg

SEQ ID NO: 4335 - RNA, 19 nt, Artificial Sequence
  Description of Artificial Sequence: Synthetic oligonucleotide
cuuggacuuugcccuucuu

SEQ ID NO: 4336 - RNA, 19 nt, Artificial Sequence
  Description of Artificial Sequence: Synthetic oligonucleotide
aagaagggcaaaguccaag

SEQ ID NO: 4337 - RNA, 19 nt, Artificial Sequence
  Description of Artificial Sequence: Synthetic oligonucleotide
uuggacuuugcccuucuua

SEQ ID NO: 4338 - RNA, 19 nt, Artificial Sequence
  Description of Artificial Sequence: Synthetic oligonucleotide
uaagaagggcaaaguccaa

SEQ ID NO: 4339 - RNA, 19 nt, Artificial Sequence
  Description of Artificial Sequence: Synthetic oligonucleotide
uggacuuugcccuucuuac

SEQ ID NO: 4340 - RNA, 19 nt, Artificial Sequence
  Description of Artificial Sequence: Synthetic oligonucleotide
guaagaagggcaaagucca

SEQ ID NO: 4341 - RNA, 19 nt, Artificial Sequence
  Description of Artificial Sequence: Synthetic oligonucleotide
ggacuuugcccuucuuacu

SEQ ID NO: 4342 - RNA, 19 nt, Artificial Sequence
  Description of Artificial Sequence: Synthetic oligonucleotide
aguaagaagggcaaagucc

SEQ ID NO: 4343 - RNA, 19 nt, Artificial Sequence
  Description of Artificial Sequence: Synthetic oligonucleotide
uuugcccuucuuacuggcc

SEQ ID NO: 4344 - RNA, 19 nt, Artificial Sequence
  Description of Artificial Sequence: Synthetic oligonucleotide
ggccaguaagaagggcaaa

SEQ ID NO: 4345 - RNA, 19 nt, Artificial Sequence
  Description of Artificial Sequence: Synthetic oligonucleotide
uugcccuucuuacuggcca

SEQ ID NO: 4346 - RNA, 19 nt, Artificial Sequence
  Description of Artificial Sequence: Synthetic oligonucleotide
uggccaguaagaagggcaa

SEQ ID NO: 4347 - RNA, 19 nt, Artificial Sequence
  Description of Artificial Sequence: Synthetic oligonucleotide
ugcccuucuuacuggccag

SEQ ID NO: 4348 - RNA, 19 nt, Artificial Sequence
  Description of Artificial Sequence: Synthetic oligonucleotide
cuggccaguaagaagggca

SEQ ID NO: 4349 - RNA, 19 nt, Artificial Sequence
  Description of Artificial Sequence: Synthetic oligonucleotide
ucuuacuggccaggcaggg

SEQ ID NO: 4350 - RNA, 19 nt, Artificial Sequence
  Description of Artificial Sequence: Synthetic oligonucleotide
cccugccuggccaguaaga

SEQ ID NO: 4351 - RNA, 19 nt, Artificial Sequence
  Description of Artificial Sequence: Synthetic oligonucleotide
ggccagaguccaggcuuga

SEQ ID NO: 4352 - RNA, 19 nt, Artificial Sequence
  Description of Artificial Sequence: Synthetic oligonucleotide
ucaagccuggacucuggcc

SEQ ID NO: 4353 - RNA, 19 nt, Artificial Sequence
  Description of Artificial Sequence: Synthetic oligonucleotide
gccagaguccaggcuugac

SEQ ID NO: 4354 - RNA, 19 nt, Artificial Sequence
  Description of Artificial Sequence: Synthetic oligonucleotide
gucaagccuggacucuggc

SEQ ID NO: 4355 - RNA, 19 nt, Artificial Sequence
  Description of Artificial Sequence: Synthetic oligonucleotide
guccaggcuugacucauuc

SEQ ID NO: 4356 - RNA, 19 nt, Artificial Sequence
  Description of Artificial Sequence: Synthetic oligonucleotide
gaaugagucaagccuggac

SEQ ID NO: 4357 - RNA, 19 nt, Artificial Sequence
  Description of Artificial Sequence: Synthetic oligonucleotide
aggcuugacucauucccac

SEQ ID NO: 4358 - RNA, 19 nt, Artificial Sequence
  Description of Artificial Sequence: Synthetic oligonucleotide
gugggaaugagucaagccu

SEQ ID NO: 4359 - RNA, 19 nt, Artificial Sequence
  Description of Artificial Sequence: Synthetic oligonucleotide
gacucauucccaccuuguc

SEQ ID NO: 4360 - RNA, 19 nt, Artificial Sequence
  Description of Artificial Sequence: Synthetic oligonucleotide
gacaaggugggaaugaguc

SEQ ID NO: 4361 - RNA, 19 nt, Artificial Sequence
  Description of Artificial Sequence: Synthetic oligonucleotide
acucauucccaccuugucc

SEQ ID NO: 4362 - RNA, 19 nt, Artificial Sequence
  Description of Artificial Sequence: Synthetic oligonucleotide
ggacaaggugggaaugagu

SEQ ID NO: 4363 - RNA, 19 nt, Artificial Sequence
  Description of Artificial Sequence: Synthetic oligonucleotide
ucauucccaccuuguccug

SEQ ID NO: 4364 - RNA, 19 nt, Artificial Sequence
  Description of Artificial Sequence: Synthetic oligonucleotide
caggacaaggugggaauga

SEQ ID NO: 4365 - RNA, 19 nt, Artificial Sequence
  Description of Artificial Sequence: Synthetic oligonucleotide
caccuuguccugggcugag

SEQ ID NO: 4366 - RNA, 19 nt, Artificial Sequence
  Description of Artificial Sequence: Synthetic oligonucleotide
cucagcccaggacaaggug

SEQ ID NO: 4367 - RNA, 19 nt, Artificial Sequence
  Description of Artificial Sequence: Synthetic oligonucleotide
accacccagcccagaaguu

SEQ ID NO: 4368 - RNA, 19 nt, Artificial Sequence
  Description of Artificial Sequence: Synthetic oligonucleotide
aacuucugggcuggguggu

SEQ ID NO: 4369 - RNA, 19 nt, Artificial Sequence
  Description of Artificial Sequence: Synthetic oligonucleotide
ccacccagcccagaaguuc

SEQ ID NO: 4370 - RNA, 19 nt, Artificial Sequence
  Description of Artificial Sequence: Synthetic oligonucleotide
gaacuucugggcugggugg

SEQ ID NO: 4371 - RNA, 19 nt, Artificial Sequence
  Description of Artificial Sequence: Synthetic oligonucleotide
cacccagcccagaaguucc

SEQ ID NO: 4372 - RNA, 19 nt, Artificial Sequence
  Description of Artificial Sequence: Synthetic oligonucleotide
ggaacuucugggcugggug

SEQ ID NO: 4373 - RNA, 19 nt, Artificial Sequence
  Description of Artificial Sequence: Synthetic oligonucleotide
acccagcccagaaguucca

SEQ ID NO: 4374 - RNA, 19 nt, Artificial Sequence
  Description of Artificial Sequence: Synthetic oligonucleotide
uggaacuucugggcugggu

SEQ ID NO: 4375 - RNA, 19 nt, Artificial Sequence
  Description of Artificial Sequence: Synthetic oligonucleotide
ccagaaguuccagggaagg

SEQ ID NO: 4376 - RNA, 19 nt, Artificial Sequence
  Description of Artificial Sequence: Synthetic oligonucleotide
ccuucccuggaacuucugg

SEQ ID NO: 4377 - RNA, 19 nt, Artificial Sequence
  Description of Artificial Sequence: Synthetic oligonucleotide
cagaaguuccagggaagga

SEQ ID NO: 4378 - RNA, 19 nt, Artificial Sequence
  Description of Artificial Sequence: Synthetic oligonucleotide
uccuucccuggaacuucug

SEQ ID NO: 4379 - RNA, 19 nt, Artificial Sequence
  Description of Artificial Sequence: Synthetic oligonucleotide
aacucuccgguccaccaug

SEQ ID NO: 4380 - RNA, 19 nt, Artificial Sequence
  Description of Artificial Sequence: Synthetic oligonucleotide
caugguggaccggagaguu

SEQ ID NO: 4381 - RNA, 19 nt, Artificial Sequence
  Description of Artificial Sequence: Synthetic oligonucleotide
acucuccgguccaccaugg

SEQ ID NO: 4382 - RNA, 19 nt, Artificial Sequence
  Description of Artificial Sequence: Synthetic oligonucleotide
ccaugguggaccggagagu

SEQ ID NO: 4383 - RNA, 19 nt, Artificial Sequence
  Description of Artificial Sequence: Synthetic oligonucleotide
caccauggaguaccucuca

SEQ ID NO: 4384 - RNA, 19 nt, Artificial Sequence
  Description of Artificial Sequence: Synthetic oligonucleotide
ugagagguacuccauggug

SEQ ID NO: 4385 - RNA, 19 nt, Artificial Sequence
  Description of Artificial Sequence: Synthetic oligonucleotide
accauggaguaccucucag

SEQ ID NO: 4386 - RNA, 19 nt, Artificial Sequence
  Description of Artificial Sequence: Synthetic oligonucleotide
cugagagguacuccauggu

SEQ ID NO: 4387 - RNA, 19 nt, Artificial Sequence
  Description of Artificial Sequence: Synthetic oligonucleotide
uggaguaccucucagcucu

SEQ ID NO: 4388 - RNA, 19 nt, Artificial Sequence
  Description of Artificial Sequence: Synthetic oligonucleotide
agagcugagagguacucca

SEQ ID NO: 4389 - RNA, 19 nt, Artificial Sequence
  Description of Artificial Sequence: Synthetic oligonucleotide
ggaguaccucucagcucug

SEQ ID NO: 4390 - RNA, 19 nt, Artificial Sequence
  Description of Artificial Sequence: Synthetic oligonucleotide
cagagcugagagguacucc

SEQ ID NO: 4391 - RNA, 19 nt, Artificial Sequence
  Description of Artificial Sequence: Synthetic oligonucleotide
gaguaccucucagcucuga

SEQ ID NO: 4392 - RNA, 19 nt, Artificial Sequence
  Description of Artificial Sequence: Synthetic oligonucleotide
ucagagcugagagguacuc

SEQ ID NO: 4393 - RNA, 19 nt, Artificial Sequence
  Description of Artificial Sequence: Synthetic oligonucleotide
aguaccucucagcucugaa

SEQ ID NO: 4394 - RNA, 19 nt, Artificial Sequence
  Description of Artificial Sequence: Synthetic oligonucleotide
uucagagcugagagguacu

SEQ ID NO: 4395 - RNA, 19 nt, Artificial Sequence
  Description of Artificial Sequence: Synthetic oligonucleotide
ccagugacuuacucaggug

SEQ ID NO: 4396 - RNA, 19 nt, Artificial Sequence
  Description of Artificial Sequence: Synthetic oligonucleotide
caccugaguaagucacugg

SEQ ID NO: 4397 - RNA, 19 nt, Artificial Sequence
  Description of Artificial Sequence: Synthetic oligonucleotide
cagugacuuacucagguga

SEQ ID NO: 4398 - RNA, 19 nt, Artificial Sequence
  Description of Artificial Sequence: Synthetic oligonucleotide
ucaccugaguaagucacug

SEQ ID NO: 4399 - RNA, 19 nt, Artificial Sequence
  Description of Artificial Sequence: Synthetic oligonucleotide
agugacuuacucaggugac

SEQ ID NO: 4400 - RNA, 19 nt, Artificial Sequence
  Description of Artificial Sequence: Synthetic oligonucleotide
gucaccugaguaagucacu

SEQ ID NO: 4401 - RNA, 19 nt, Artificial Sequence
  Description of Artificial Sequence: Synthetic oligonucleotide
gugacuuacucaggugacu

SEQ ID NO: 4402 - RNA, 19 nt, Artificial Sequence
  Description of Artificial Sequence: Synthetic oligonucleotide
agucaccugaguaagucac

SEQ ID NO: 4403 - RNA, 19 nt, Artificial Sequence
  Description of Artificial Sequence: Synthetic oligonucleotide
ugacuuacucaggugacug

SEQ ID NO: 4404 - RNA, 19 nt, Artificial Sequence
  Description of Artificial Sequence: Synthetic oligonucleotide
cagucaccugaguaaguca

SEQ ID NO: 4405 - RNA, 19 nt, Artificial Sequence
  Description of Artificial Sequence: Synthetic oligonucleotide
gacuuacucaggugacugc

SEQ ID NO: 4406 - RNA, 19 nt, Artificial Sequence
  Description of Artificial Sequence: Synthetic oligonucleotide
gcagucaccugaguaaguc

SEQ ID NO: 4407 - RNA, 19 nt, Artificial Sequence
  Description of Artificial Sequence: Synthetic oligonucleotide
acuuacucaggugacugcu

SEQ ID NO: 4408 - RNA, 19 nt, Artificial Sequence
  Description of Artificial Sequence: Synthetic oligonucleotide
agcagucaccugaguaagu

SEQ ID NO: 4409 - RNA, 19 nt, Artificial Sequence
  Description of Artificial Sequence: Synthetic oligonucleotide
cuuacucaggugacugcua

SEQ ID NO: 4410 - RNA, 19 nt, Artificial Sequence
  Description of Artificial Sequence: Synthetic oligonucleotide
uagcagucaccugaguaag

SEQ ID NO: 4411 - RNA, 19 nt, Artificial Sequence
  Description of Artificial Sequence: Synthetic oligonucleotide
uuacucaggugacugcuaa

SEQ ID NO: 4412 - RNA, 19 nt, Artificial Sequence
  Description of Artificial Sequence: Synthetic oligonucleotide
uuagcagucaccugaguaa

SEQ ID NO: 4413 - RNA, 19 nt, Artificial Sequence
  Description of Artificial Sequence: Synthetic oligonucleotide
uacucaggugacugcuaac

SEQ ID NO: 4414 - RNA, 19 nt, Artificial Sequence
  Description of Artificial Sequence: Synthetic oligonucleotide
guuagcagucaccugagua

SEQ ID NO: 4415 - RNA, 19 nt, Artificial Sequence
  Description of Artificial Sequence: Synthetic oligonucleotide
acucaggugacugcuaacc

SEQ ID NO: 4416 - RNA, 19 nt, Artificial Sequence
  Description of Artificial Sequence: Synthetic oligonucleotide
gguuagcagucaccugagu

SEQ ID NO: 4417 - RNA, 19 nt, Artificial Sequence
  Description of Artificial Sequence: Synthetic oligonucleotide
cucaggugacugcuaaccc

SEQ ID NO: 4418 - RNA, 19 nt, Artificial Sequence
  Description of Artificial Sequence: Synthetic oligonucleotide
ggguuagcagucaccugag

SEQ ID NO: 4419 - RNA, 19 nt, Artificial Sequence
  Description of Artificial Sequence: Synthetic oligonucleotide
ggugacugcuaacccuccg

SEQ ID NO: 4420 - RNA, 19 nt, Artificial Sequence
  Description of Artificial Sequence: Synthetic oligonucleotide
cggaggguuagcagucacc

SEQ ID NO: 4421 - RNA, 19 nt, Artificial Sequence
  Description of Artificial Sequence: Synthetic oligonucleotide
gugacugcuaacccuccgc

SEQ ID NO: 4422 - RNA, 19 nt, Artificial Sequence
  Description of Artificial Sequence: Synthetic oligonucleotide
gcggaggguuagcagucac

SEQ ID NO: 4423 - RNA, 19 nt, Artificial Sequence
  Description of Artificial Sequence: Synthetic oligonucleotide
ugacugcuaacccuccgcu

SEQ ID NO: 4424 - RNA, 19 nt, Artificial Sequence
  Description of Artificial Sequence: Synthetic oligonucleotide
agcggaggguuagcaguca

SEQ ID NO: 4425 - RNA, 19 nt, Artificial Sequence
  Description of Artificial Sequence: Synthetic oligonucleotide
gacugcuaacccuccgcuc

SEQ ID NO: 4426 - RNA, 19 nt, Artificial Sequence
  Description of Artificial Sequence: Synthetic oligonucleotide
gagcggaggguuagcaguc

SEQ ID NO: 4427 - RNA, 19 nt, Artificial Sequence
  Description of Artificial Sequence: Synthetic oligonucleotide
acugcuaacccuccgcucu

SEQ ID NO: 4428 - RNA, 19 nt, Artificial Sequence
  Description of Artificial Sequence: Synthetic oligonucleotide
agagcggaggguuagcagu

SEQ ID NO: 4429 - RNA, 19 nt, Artificial Sequence
  Description of Artificial Sequence: Synthetic oligonucleotide
cugcuaacccuccgcucua

SEQ ID NO: 4430 - RNA, 19 nt, Artificial Sequence
  Description of Artificial Sequence: Synthetic oligonucleotide
uagagcggaggguuagcag

SEQ ID NO: 4431 - RNA, 19 nt, Artificial Sequence
  Description of Artificial Sequence: Synthetic oligonucleotide
ugcuaacccuccgcucuac

SEQ ID NO: 4432 - RNA, 19 nt, Artificial Sequence
  Description of Artificial Sequence: Synthetic oligonucleotide
guagagcggaggguuagca

SEQ ID NO: 4433 - RNA, 19 nt, Artificial Sequence
  Description of Artificial Sequence: Synthetic oligonucleotide
aacccuccgcucuacccuc

SEQ ID NO: 4434 - RNA, 19 nt, Artificial Sequence
  Description of Artificial Sequence: Synthetic oligonucleotide
gaggguagagcggaggguu

SEQ ID NO: 4435 - RNA, 19 nt, Artificial Sequence
  Description of Artificial Sequence: Synthetic oligonucleotide
acuccacagugggcuuguc

SEQ ID NO: 4436 - RNA, 19 nt, Artificial Sequence
  Description of Artificial Sequence: Synthetic oligonucleotide
gacaagcccacuguggagu

SEQ ID NO: 4437 - RNA, 19 nt, Artificial Sequence
  Description of Artificial Sequence: Synthetic oligonucleotide
cuccacagugggcuuguca

SEQ ID NO: 4438 - RNA, 19 nt, Artificial Sequence
  Description of Artificial Sequence: Synthetic oligonucleotide
ugacaagcccacuguggag

SEQ ID NO: 4439 - RNA, 19 nt, Artificial Sequence
  Description of Artificial Sequence: Synthetic oligonucleotide
uccacagugggcuugucaa

SEQ ID NO: 4440 - RNA, 19 nt, Artificial Sequence
  Description of Artificial Sequence: Synthetic oligonucleotide
uugacaagcccacugugga

SEQ ID NO: 4441 - RNA, 19 nt, Artificial Sequence
  Description of Artificial Sequence: Synthetic oligonucleotide
ccacagugggcuugucaag

SEQ ID NO: 4442 - RNA, 19 nt, Artificial Sequence
  Description of Artificial Sequence: Synthetic oligonucleotide
cuugacaagcccacugugg

SEQ ID NO: 4443 - RNA, 19 nt, Artificial Sequence
  Description of Artificial Sequence: Synthetic oligonucleotide
gucaagcuccugagccacc

SEQ ID NO: 4444 - RNA, 19 nt, Artificial Sequence
  Description of Artificial Sequence: Synthetic oligonucleotide
gguggcucaggagcuugac

SEQ ID NO: 4445 - RNA, 19 nt, Artificial Sequence
  Description of Artificial Sequence: Synthetic oligonucleotide
ccauggucucucccucauc

SEQ ID NO: 4446 - RNA, 19 nt, Artificial Sequence
  Description of Artificial Sequence: Synthetic oligonucleotide
gaugagggagagaccaugg

SEQ ID NO: 4447 - RNA, 19 nt, Artificial Sequence
  Description of Artificial Sequence: Synthetic oligonucleotide
cauggucucucccucaucc

SEQ ID NO: 4448 - RNA, 19 nt, Artificial Sequence
  Description of Artificial Sequence: Synthetic oligonucleotide
ggaugagggagagaccaug

SEQ ID NO: 4449 - RNA, 19 nt, Artificial Sequence
  Description of Artificial Sequence: Synthetic oligonucleotide
auggucucucccucauccc

SEQ ID NO: 4450 - RNA, 19 nt, Artificial Sequence
  Description of Artificial Sequence: Synthetic oligonucleotide
gggaugagggagagaccau

SEQ ID NO: 4451 - RNA, 19 nt, Artificial Sequence
  Description of Artificial Sequence: Synthetic oligonucleotide
ucucucccucaucccuaau

SEQ ID NO: 4452 - RNA, 19 nt, Artificial Sequence
  Description of Artificial Sequence: Synthetic oligonucleotide
auuagggaugagggagaga

SEQ ID NO: 4453 - RNA, 19 nt, Artificial Sequence
  Description of Artificial Sequence: Synthetic oligonucleotide
cucucccucaucccuaauc

SEQ ID NO: 4454 - RNA, 19 nt, Artificial Sequence
  Description of Artificial Sequence: Synthetic oligonucleotide
gauuagggaugagggagag

SEQ ID NO: 4455 - RNA, 19 nt, Artificial Sequence
  Description of Artificial Sequence: Synthetic oligonucleotide
ucucccucaucccuaaucg

SEQ ID NO: 4456 - RNA, 19 nt, Artificial Sequence
  Description of Artificial Sequence: Synthetic oligonucleotide
cgauuagggaugagggaga

SEQ ID NO: 4457 - RNA, 19 nt, Artificial Sequence
  Description of Artificial Sequence: Synthetic oligonucleotide
cucccucaucccuaaucga

SEQ ID NO: 4458 - RNA, 19 nt, Artificial Sequence
  Description of Artificial Sequence: Synthetic oligonucleotide
ucgauuagggaugagggag

SEQ ID NO: 4459 - RNA, 19 nt, Artificial Sequence
  Description of Artificial Sequence: Synthetic oligonucleotide
ucccucaucccuaaucgau

SEQ ID NO: 4460 - RNA, 19 nt, Artificial Sequence
  Description of Artificial Sequence: Synthetic oligonucleotide
aucgauuagggaugaggga

SEQ ID NO: 4461 - RNA, 19 nt, Artificial Sequence
  Description of Artificial Sequence: Synthetic oligonucleotide
cccucaucccuaaucgaua

SEQ ID NO: 4462 - RNA, 19 nt, Artificial Sequence
  Description of Artificial Sequence: Synthetic oligonucleotide
uaucgauuagggaugaggg

SEQ ID NO: 4463 - RNA, 19 nt, Artificial Sequence
  Description of Artificial Sequence: Synthetic oligonucleotide
ccucaucccuaaucgauaa

SEQ ID NO: 4464 - RNA, 19 nt, Artificial Sequence
  Description of Artificial Sequence: Synthetic oligonucleotide
uuaucgauuagggaugagg

SEQ ID NO: 4465 - RNA, 19 nt, Artificial Sequence
  Description of Artificial Sequence: Synthetic oligonucleotide
cucaucccuaaucgauaaa

SEQ ID NO: 4466 - RNA, 19 nt, Artificial Sequence
  Description of Artificial Sequence: Synthetic oligonucleotide
uuuaucgauuagggaugag

SEQ ID NO: 4467 - RNA, 19 nt, Artificial Sequence
  Description of Artificial Sequence: Synthetic oligonucleotide
aaccuagaucucucccucc

SEQ ID NO: 4468 - RNA, 19 nt, Artificial Sequence
  Description of Artificial Sequence: Synthetic oligonucleotide
ggagggagagaucuagguu

SEQ ID NO: 4469 - RNA, 19 nt, Artificial Sequence
  Description of Artificial Sequence: Synthetic oligonucleotide
accuagaucucucccuccc

SEQ ID NO: 4470 - RNA, 19 nt, Artificial Sequence
  Description of Artificial Sequence: Synthetic oligonucleotide
gggagggagagaucuaggu

SEQ ID NO: 4471 - RNA, 19 nt, Artificial Sequence
  Description of Artificial Sequence: Synthetic oligonucleotide
cuagaucucucccucccua

SEQ ID NO: 4472 - RNA, 19 nt, Artificial Sequence
  Description of Artificial Sequence: Synthetic oligonucleotide
uagggagggagagaucuag

SEQ ID NO: 4473 - RNA, 19 nt, Artificial Sequence
  Description of Artificial Sequence: Synthetic oligonucleotide
uagaucucucccucccuag

SEQ ID NO: 4474 - RNA, 19 nt, Artificial Sequence
  Description of Artificial Sequence: Synthetic oligonucleotide
cuagggagggagagaucua

SEQ ID NO: 4475 - RNA, 19 nt, Artificial Sequence
  Description of Artificial Sequence: Synthetic oligonucleotide
agaucucucccucccuagc

SEQ ID NO: 4476 - RNA, 19 nt, Artificial Sequence
  Description of Artificial Sequence: Synthetic oligonucleotide
gcuagggagggagagaucu

SEQ ID NO: 4477 - RNA, 19 nt, Artificial Sequence
  Description of Artificial Sequence: Synthetic oligonucleotide
gaucucucccucccuagcc

SEQ ID NO: 4478 - RNA, 19 nt, Artificial Sequence
  Description of Artificial Sequence: Synthetic oligonucleotide
ggcuagggagggagagauc

SEQ ID NO: 4479 - RNA, 19 nt, Artificial Sequence
  Description of Artificial Sequence: Synthetic oligonucleotide
aucucucccucccuagccc

SEQ ID NO: 4480 - RNA, 19 nt, Artificial Sequence
  Description of Artificial Sequence: Synthetic oligonucleotide
gggcuagggagggagagau

SEQ ID NO: 4481 - RNA, 19 nt, Artificial Sequence
  Description of Artificial Sequence: Synthetic oligonucleotide
uagcccucuagccacucua

SEQ ID NO: 4482 - RNA, 19 nt, Artificial Sequence
  Description of Artificial Sequence: Synthetic oligonucleotide
uagaguggcuagagggcua

SEQ ID NO: 4483 - RNA, 19 nt, Artificial Sequence
  Description of Artificial Sequence: Synthetic oligonucleotide
agcccucuagccacucuac

SEQ ID NO: 4484 - RNA, 19 nt, Artificial Sequence
  Description of Artificial Sequence: Synthetic oligonucleotide
guagaguggcuagagggcu

SEQ ID NO: 4485 - RNA, 19 nt, Artificial Sequence
  Description of Artificial Sequence: Synthetic oligonucleotide
cucuagccacucuacccuc

SEQ ID NO: 4486 - RNA, 19 nt, Artificial Sequence
  Description of Artificial Sequence: Synthetic oligonucleotide
gaggguagaguggcuagag

SEQ ID NO: 4487 - RNA, 19 nt, Artificial Sequence
  Description of Artificial Sequence: Synthetic oligonucleotide
ucuagccacucuacccuca

SEQ ID NO: 4488 - RNA, 19 nt, Artificial Sequence
  Description of Artificial Sequence: Synthetic oligonucleotide
ugaggguagaguggcuaga

SEQ ID NO: 4489 - RNA, 19 nt, Artificial Sequence
  Description of Artificial Sequence: Synthetic oligonucleotide
cuagccacucuacccucau

SEQ ID NO: 4490 - RNA, 19 nt, Artificial Sequence
  Description of Artificial Sequence: Synthetic oligonucleotide
augaggguagaguggcuag

SEQ ID NO: 4491 - RNA, 19 nt, Artificial Sequence
  Description of Artificial Sequence: Synthetic oligonucleotide
uagccacucuacccucauc

SEQ ID NO: 4492 - RNA, 19 nt, Artificial Sequence
  Description of Artificial Sequence: Synthetic oligonucleotide
gaugaggguagaguggcua

SEQ ID NO: 4493 - RNA, 19 nt, Artificial Sequence
  Description of Artificial Sequence: Synthetic oligonucleotide
agccacucuacccucauca

SEQ ID NO: 4494 - RNA, 19 nt, Artificial Sequence
  Description of Artificial Sequence: Synthetic oligonucleotide
ugaugaggguagaguggcu

SEQ ID NO: 4495 - RNA, 19 nt, Artificial Sequence
  Description of Artificial Sequence: Synthetic oligonucleotide
gccacucuacccucaucau

SEQ ID NO: 4496 - RNA, 19 nt, Artificial Sequence
  Description of Artificial Sequence: Synthetic oligonucleotide
augaugaggguagaguggc

SEQ ID NO: 4497 - RNA, 19 nt, Artificial Sequence
  Description of Artificial Sequence: Synthetic oligonucleotide
ccacucuacccucaucaug

SEQ ID NO: 4498 - RNA, 19 nt, Artificial Sequence
  Description of Artificial Sequence: Synthetic oligonucleotide
caugaugaggguagagugg

SEQ ID NO: 4499 - RNA, 19 nt, Artificial Sequence
  Description of Artificial Sequence: Synthetic oligonucleotide
cacucuacccucaucaugc

SEQ ID NO: 4500 - RNA, 19 nt, Artificial Sequence
  Description of Artificial Sequence: Synthetic oligonucleotide
gcaugaugaggguagagug

SEQ ID NO: 4501 - RNA, 19 nt, Artificial Sequence
  Description of Artificial Sequence: Synthetic oligonucleotide
acucuacccucaucaugcc

SEQ ID NO: 4502 - RNA, 19 nt, Artificial Sequence
  Description of Artificial Sequence: Synthetic oligonucleotide
ggcaugaugaggguagagu

SEQ ID NO: 4503 - RNA, 19 nt, Artificial Sequence
  Description of Artificial Sequence: Synthetic oligonucleotide
cucuacccucaucaugccc

SEQ ID NO: 4504 - RNA, 19 nt, Artificial Sequence
  Description of Artificial Sequence: Synthetic oligonucleotide
gggcaugaugaggguagag

SEQ ID NO: 4505 - RNA, 19 nt, Artificial Sequence
  Description of Artificial Sequence: Synthetic oligonucleotide
ucuacccucaucaugcccu

SEQ ID NO: 4506 - RNA, 19 nt, Artificial Sequence
  Description of Artificial Sequence: Synthetic oligonucleotide
agggcaugaugaggguaga

SEQ ID NO: 4507 - RNA, 19 nt, Artificial Sequence
  Description of Artificial Sequence: Synthetic oligonucleotide
cuacccucaucaugcccuu

SEQ ID NO: 4508 - RNA, 19 nt, Artificial Sequence
  Description of Artificial Sequence: Synthetic oligonucleotide
aagggcaugaugaggguag

SEQ ID NO: 4509 - RNA, 19 nt, Artificial Sequence
  Description of Artificial Sequence: Synthetic oligonucleotide
uacccucaucaugcccuuu

SEQ ID NO: 4510 - RNA, 19 nt, Artificial Sequence
  Description of Artificial Sequence: Synthetic oligonucleotide
aaagggcaugaugagggua

SEQ ID NO: 4511 - RNA, 19 nt, Artificial Sequence
  Description of Artificial Sequence: Synthetic oligonucleotide
acccucaucaugcccuuua

SEQ ID NO: 4512 - RNA, 19 nt, Artificial Sequence
  Description of Artificial Sequence: Synthetic oligonucleotide
uaaagggcaugaugagggu

SEQ ID NO: 4513 - RNA, 19 nt, Artificial Sequence
  Description of Artificial Sequence: Synthetic oligonucleotide
cccucaucaugcccuuuac

SEQ ID NO: 4514 - RNA, 19 nt, Artificial Sequence
  Description of Artificial Sequence: Synthetic oligonucleotide
guaaagggcaugaugaggg

SEQ ID NO: 4515 - RNA, 19 nt, Artificial Sequence
  Description of Artificial Sequence: Synthetic oligonucleotide
cucaucaugcccuuuacac

SEQ ID NO: 4516 - RNA, 19 nt, Artificial Sequence
  Description of Artificial Sequence: Synthetic oligonucleotide
guguaaagggcaugaugag

SEQ ID NO: 4517 - RNA, 19 nt, Artificial Sequence
  Description of Artificial Sequence: Synthetic oligonucleotide
ucaucaugcccuuuacacu

SEQ ID NO: 4518 - RNA, 19 nt, Artificial Sequence
  Description of Artificial Sequence: Synthetic oligonucleotide
aguguaaagggcaugauga

SEQ ID NO: 4519 - RNA, 19 nt, Artificial Sequence
  Description of Artificial Sequence: Synthetic oligonucleotide
cccuucuugacuuuucuuc

SEQ ID NO: 4520 - RNA, 19 nt, Artificial Sequence
  Description of Artificial Sequence: Synthetic oligonucleotide
gaagaaaagucaagaaggg

SEQ ID NO: 4521 - RNA, 19 nt, Artificial Sequence
  Description of Artificial Sequence: Synthetic oligonucleotide
cuucuugacuuuucuucuc

SEQ ID NO: 4522 - RNA, 19 nt, Artificial Sequence
  Description of Artificial Sequence: Synthetic oligonucleotide
gagaagaaaagucaagaag

SEQ ID NO: 4523 - RNA, 19 nt, Artificial Sequence
  Description of Artificial Sequence: Synthetic oligonucleotide
gacuuuucuucucaacuac

SEQ ID NO: 4524 - RNA, 19 nt, Artificial Sequence
  Description of Artificial Sequence: Synthetic oligonucleotide
guaguugagaagaaaaguc

SEQ ID NO: 4525 - RNA, 19 nt, Artificial Sequence
  Description of Artificial Sequence: Synthetic oligonucleotide
acuuuucuucucaacuacc

SEQ ID NO: 4526 - RNA, 19 nt, Artificial Sequence
  Description of Artificial Sequence: Synthetic oligonucleotide
gguaguugagaagaaaagu

SEQ ID NO: 4527 - RNA, 19 nt, Artificial Sequence
  Description of Artificial Sequence: Synthetic oligonucleotide
cuuuucuucucaacuacca

SEQ ID NO: 4528 - RNA, 19 nt, Artificial Sequence
  Description of Artificial Sequence: Synthetic oligonucleotide
ugguaguugagaagaaaag

SEQ ID NO: 4529 - RNA, 19 nt, Artificial Sequence
  Description of Artificial Sequence: Synthetic oligonucleotide
uuuucuucucaacuaccag

SEQ ID NO: 4530 - RNA, 19 nt, Artificial Sequence
  Description of Artificial Sequence: Synthetic oligonucleotide
cugguaguugagaagaaaa

SEQ ID NO: 4531 - RNA, 19 nt, Artificial Sequence
  Description of Artificial Sequence: Synthetic oligonucleotide
uaucuaauauaagcucgga

SEQ ID NO: 4532 - RNA, 19 nt, Artificial Sequence
  Description of Artificial Sequence: Synthetic oligonucleotide
uccgagcuuauauuagaua

SEQ ID NO: 4533 - RNA, 19 nt, Artificial Sequence
  Description of Artificial Sequence: Synthetic oligonucleotide
aucuaauauaagcucggag

SEQ ID NO: 4534 - RNA, 19 nt, Artificial Sequence
  Description of Artificial Sequence: Synthetic oligonucleotide
cuccgagcuuauauuagau

SEQ ID NO: 4535 - RNA, 19 nt, Artificial Sequence
  Description of Artificial Sequence: Synthetic oligonucleotide
ucuaauauaagcucggagu

SEQ ID NO: 4536 - RNA, 19 nt, Artificial Sequence
  Description of Artificial Sequence: Synthetic oligonucleotide
acuccgagcuuauauuaga

SEQ ID NO: 4537 - RNA, 19 nt, Artificial Sequence
  Description of Artificial Sequence: Synthetic oligonucleotide
cuaauauaagcucggaguu

SEQ ID NO: 4538 - RNA, 19 nt, Artificial Sequence
  Description of Artificial Sequence: Synthetic oligonucleotide
aacuccgagcuuauauuag

SEQ ID NO: 4539 - RNA, 19 nt, Artificial Sequence
  Description of Artificial Sequence: Synthetic oligonucleotide
uaauauaagcucggaguuu

SEQ ID NO: 4540 - RNA, 19 nt, Artificial Sequence
  Description of Artificial Sequence: Synthetic oligonucleotide
aaacuccgagcuuauauua

SEQ ID NO: 4541 - RNA, 19 nt, Artificial Sequence
  Description of Artificial Sequence: Synthetic oligonucleotide
aauauaagcucggaguuug

SEQ ID NO: 4542 - RNA, 19 nt, Artificial Sequence
  Description of Artificial Sequence: Synthetic oligonucleotide
caaacuccgagcuuauauu

SEQ ID NO: 4543 - RNA, 19 nt, Artificial Sequence
  Description of Artificial Sequence: Synthetic oligonucleotide
auauaagcucggaguuugg

SEQ ID NO: 4544 - RNA, 19 nt, Artificial Sequence
  Description of Artificial Sequence: Synthetic oligonucleotide
ccaaacuccgagcuuauau

SEQ ID NO: 4545 - RNA, 19 nt, Artificial Sequence
  Description of Artificial Sequence: Synthetic oligonucleotide
uauaagcucggaguuugga

SEQ ID NO: 4546 - RNA, 19 nt, Artificial Sequence
  Description of Artificial Sequence: Synthetic oligonucleotide
uccaaacuccgagcuuaua

SEQ ID NO: 4547 - RNA, 19 nt, Artificial Sequence
  Description of Artificial Sequence: Synthetic oligonucleotide
auaagcucggaguuuggac

SEQ ID NO: 4548 - RNA, 19 nt, Artificial Sequence
  Description of Artificial Sequence: Synthetic oligonucleotide
guccaaacuccgagcuuau

SEQ ID NO: 4549 - RNA, 19 nt, Artificial Sequence
  Description of Artificial Sequence: Synthetic oligonucleotide
uaagcucggaguuuggacg

SEQ ID NO: 4550 - RNA, 19 nt, Artificial Sequence
  Description of Artificial Sequence: Synthetic oligonucleotide
cguccaaacuccgagcuua

SEQ ID NO: 4551 - RNA, 19 nt, Artificial Sequence
  Description of Artificial Sequence: Synthetic oligonucleotide
aagcucggaguuuggacgg

SEQ ID NO: 4552 - RNA, 19 nt, Artificial Sequence
  Description of Artificial Sequence: Synthetic oligonucleotide
ccguccaaacuccgagcuu

SEQ ID NO: 4553 - RNA, 19 nt, Artificial Sequence
  Description of Artificial Sequence: Synthetic oligonucleotide
agcucggaguuuggacgga

SEQ ID NO: 4554 - RNA, 19 nt, Artificial Sequence
  Description of Artificial Sequence: Synthetic oligonucleotide
uccguccaaacuccgagcu

SEQ ID NO: 4555 - RNA, 19 nt, Artificial Sequence
  Description of Artificial Sequence: Synthetic oligonucleotide
gcucggaguuuggacggag

SEQ ID NO: 4556 - RNA, 19 nt, Artificial Sequence
  Description of Artificial Sequence: Synthetic oligonucleotide
cuccguccaaacuccgagc

SEQ ID NO: 4557 - RNA, 19 nt, Artificial Sequence
  Description of Artificial Sequence: Synthetic oligonucleotide
cucggaguuuggacggagg

SEQ ID NO: 4558 - RNA, 19 nt, Artificial Sequence
  Description of Artificial Sequence: Synthetic oligonucleotide
ccuccguccaaacuccgag

SEQ ID NO: 4559 - RNA, 19 nt, Artificial Sequence
  Description of Artificial Sequence: Synthetic oligonucleotide
ucggaguuuggacggaggg

SEQ ID NO: 4560 - RNA, 19 nt, Artificial Sequence
  Description of Artificial Sequence: Synthetic oligonucleotide
cccuccguccaaacuccga

SEQ ID NO: 4561 - RNA, 19 nt, Artificial Sequence
  Description of Artificial Sequence: Synthetic oligonucleotide
cggaguuuggacggagggu

SEQ ID NO: 4562 - RNA, 19 nt, Artificial Sequence
  Description of Artificial Sequence: Synthetic oligonucleotide
acccuccguccaaacuccg

SEQ ID NO: 4563 - RNA, 19 nt, Artificial Sequence
  Description of Artificial Sequence: Synthetic oligonucleotide
uuuggacggagggucugga

SEQ ID NO: 4564 - RNA, 19 nt, Artificial Sequence
  Description of Artificial Sequence: Synthetic oligonucleotide
uccagacccuccguccaaa

SEQ ID NO: 4565 - RNA, 19 nt, Artificial Sequence
  Description of Artificial Sequence: Synthetic oligonucleotide
cccagcgaccuuuccgugu

SEQ ID NO: 4566 - RNA, 19 nt, Artificial Sequence
  Description of Artificial Sequence: Synthetic oligonucleotide
acacggaaaggucgcuggg

SEQ ID NO: 4567 - RNA, 19 nt, Artificial Sequence
  Description of Artificial Sequence: Synthetic oligonucleotide
ccagcgaccuuuccguguc

SEQ ID NO: 4568 - RNA, 19 nt, Artificial Sequence
  Description of Artificial Sequence: Synthetic oligonucleotide
gacacggaaaggucgcugg

SEQ ID NO: 4569 - RNA, 19 nt, Artificial Sequence
  Description of Artificial Sequence: Synthetic oligonucleotide
cagcgaccuuuccgugucu

SEQ ID NO: 4570 - RNA, 19 nt, Artificial Sequence
  Description of Artificial Sequence: Synthetic oligonucleotide
agacacggaaaggucgcug

SEQ ID NO: 4571 - RNA, 19 nt, Artificial Sequence
  Description of Artificial Sequence: Synthetic oligonucleotide
agcgaccuuuccgugucug

SEQ ID NO: 4572 - RNA, 19 nt, Artificial Sequence
  Description of Artificial Sequence: Synthetic oligonucleotide
cagacacggaaaggucgcu

SEQ ID NO: 4573 - RNA, 19 nt, Artificial Sequence
  Description of Artificial Sequence: Synthetic oligonucleotide
gcgaccuuuccgugucugu

SEQ ID NO: 4574 - RNA, 19 nt, Artificial Sequence
  Description of Artificial Sequence: Synthetic oligonucleotide
acagacacggaaaggucgc

SEQ ID NO: 4575 - RNA, 19 nt, Artificial Sequence
  Description of Artificial Sequence: Synthetic oligonucleotide
cgaccuuuccgugucugug

SEQ ID NO: 4576 - RNA, 19 nt, Artificial Sequence
  Description of Artificial Sequence: Synthetic oligonucleotide
cacagacacggaaaggucg

SEQ ID NO: 4577 - RNA, 19 nt, Artificial Sequence
  Description of Artificial Sequence: Synthetic oligonucleotide
cuuuccgugucugugauca

SEQ ID NO: 4578 - RNA, 19 nt, Artificial Sequence
  Description of Artificial Sequence: Synthetic oligonucleotide
ugaucacagacacggaaag

SEQ ID NO: 4579 - RNA, 19 nt, Artificial Sequence
  Description of Artificial Sequence: Synthetic oligonucleotide
uuuccgugucugugaucac

SEQ ID NO: 4580 - RNA, 19 nt, Artificial Sequence
  Description of Artificial Sequence: Synthetic oligonucleotide
gugaucacagacacggaaa

SEQ ID NO: 4581 - RNA, 19 nt, Artificial Sequence
  Description of Artificial Sequence: Synthetic oligonucleotide
uuccgugucugugaucaca

SEQ ID NO: 4582 - RNA, 19 nt, Artificial Sequence
  Description of Artificial Sequence: Synthetic oligonucleotide
ugugaucacagacacggaa

SEQ ID NO: 4583 - RNA, 19 nt, Artificial Sequence
  Description of Artificial Sequence: Synthetic oligonucleotide
aaggccugacagcugccac

SEQ ID NO: 4584 - RNA, 19 nt, Artificial Sequence
  Description of Artificial Sequence: Synthetic oligonucleotide
guggcagcugucaggccuu

SEQ ID NO: 4585 - RNA, 19 nt, Artificial Sequence
  Description of Artificial Sequence: Synthetic oligonucleotide
gccaggagcugcuagccaa

SEQ ID NO: 4586 - RNA, 19 nt, Artificial Sequence
  Description of Artificial Sequence: Synthetic oligonucleotide
uuggcuagcagcuccuggc

SEQ ID NO: 4587 - RNA, 19 nt, Artificial Sequence
  Description of Artificial Sequence: Synthetic oligonucleotide
ccaggagcugcuagccaaa

SEQ ID NO: 4588 - RNA, 19 nt, Artificial Sequence
  Description of Artificial Sequence: Synthetic oligonucleotide
uuuggcuagcagcuccugg

SEQ ID NO: 4589 - RNA, 19 nt, Artificial Sequence
  Description of Artificial Sequence: Synthetic oligonucleotide
gagcugcuagccaaaguaa

SEQ ID NO: 4590 - RNA, 19 nt, Artificial Sequence
  Description of Artificial Sequence: Synthetic oligonucleotide
uuacuuuggcuagcagcuc

SEQ ID NO: 4591 - RNA, 19 nt, Artificial Sequence
  Description of Artificial Sequence: Synthetic oligonucleotide
agcugcuagccaaaguaag

SEQ ID NO: 4592 - RNA, 19 nt, Artificial Sequence
  Description of Artificial Sequence: Synthetic oligonucleotide
cuuacuuuggcuagcagcu

SEQ ID NO: 4593 - RNA, 19 nt, Artificial Sequence
  Description of Artificial Sequence: Synthetic oligonucleotide
gcugcuagccaaaguaagu

SEQ ID NO: 4594 - RNA, 19 nt, Artificial Sequence
  Description of Artificial Sequence: Synthetic oligonucleotide
acuuacuuuggcuagcagc

SEQ ID NO: 4595 - RNA, 19 nt, Artificial Sequence
  Description of Artificial Sequence: Synthetic oligonucleotide
cugcuagccaaaguaagua

SEQ ID NO: 4596 - RNA, 19 nt, Artificial Sequence
  Description of Artificial Sequence: Synthetic oligonucleotide
uacuuacuuuggcuagcag

SEQ ID NO: 4597 - RNA, 19 nt, Artificial Sequence
  Description of Artificial Sequence: Synthetic oligonucleotide
ugcuagccaaaguaaguag

SEQ ID NO: 4598 - RNA, 19 nt, Artificial Sequence
  Description of Artificial Sequence: Synthetic oligonucleotide
cuacuuacuuuggcuagca

SEQ ID NO: 4599 - RNA, 19 nt, Artificial Sequence
  Description of Artificial Sequence: Synthetic oligonucleotide
gcuagccaaaguaaguagg

SEQ ID NO: 4600 - RNA, 19 nt, Artificial Sequence
  Description of Artificial Sequence: Synthetic oligonucleotide
ccuacuuacuuuggcuagc

SEQ ID NO: 4601 - RNA, 19 nt, Artificial Sequence
  Description of Artificial Sequence: Synthetic oligonucleotide
uagccaaaguaaguaggcc

SEQ ID NO: 4602 - RNA, 19 nt, Artificial Sequence
  Description of Artificial Sequence: Synthetic oligonucleotide
ggccuacuuacuuuggcua

SEQ ID NO: 4603 - RNA, 19 nt, Artificial Sequence
  Description of Artificial Sequence: Synthetic oligonucleotide
agccaaaguaaguaggcca

SEQ ID NO: 4604 - RNA, 19 nt, Artificial Sequence
  Description of Artificial Sequence: Synthetic oligonucleotide
uggccuacuuacuuuggcu

SEQ ID NO: 4605 - RNA, 19 nt, Artificial Sequence
  Description of Artificial Sequence: Synthetic oligonucleotide
gccaaaguaaguaggccaa

SEQ ID NO: 4606 - RNA, 19 nt, Artificial Sequence
  Description of Artificial Sequence: Synthetic oligonucleotide
uuggccuacuuacuuuggc

SEQ ID NO: 4607 - RNA, 19 nt, Artificial Sequence
  Description of Artificial Sequence: Synthetic oligonucleotide
ccaaaguaaguaggccaag

SEQ ID NO: 4608 - RNA, 19 nt, Artificial Sequence
  Description of Artificial Sequence: Synthetic oligonucleotide
cuuggccuacuuacuuugg

SEQ ID NO: 4609 - RNA, 19 nt, Artificial Sequence
  Description of Artificial Sequence: Synthetic oligonucleotide
caaaguaaguaggccaagu

SEQ ID NO: 4610 - RNA, 19 nt, Artificial Sequence
  Description of Artificial Sequence: Synthetic oligonucleotide
acuuggccuacuuacuuug

SEQ ID NO: 4611 - RNA, 19 nt, Artificial Sequence
  Description of Artificial Sequence: Synthetic oligonucleotide
aaaguaaguaggccaaguu

SEQ ID NO: 4612 - RNA, 19 nt, Artificial Sequence
  Description of Artificial Sequence: Synthetic oligonucleotide
aacuuggccuacuuacuuu

SEQ ID NO: 4613 - RNA, 19 nt, Artificial Sequence
  Description of Artificial Sequence: Synthetic oligonucleotide
aaguaaguaggccaaguuc

SEQ ID NO: 4614 - RNA, 19 nt, Artificial Sequence
  Description of Artificial Sequence: Synthetic oligonucleotide
gaacuuggccuacuuacuu

SEQ ID NO: 4615 - RNA, 19 nt, Artificial Sequence
  Description of Artificial Sequence: Synthetic oligonucleotide
aguaaguaggccaaguucc

SEQ ID NO: 4616 - RNA, 19 nt, Artificial Sequence
  Description of Artificial Sequence: Synthetic oligonucleotide
ggaacuuggccuacuuacu

SEQ ID NO: 4617 - RNA, 19 nt, Artificial Sequence
  Description of Artificial Sequence: Synthetic oligonucleotide
guaaguaggccaaguuccu

SEQ ID NO: 4618 - RNA, 19 nt, Artificial Sequence
  Description of Artificial Sequence: Synthetic oligonucleotide
aggaacuuggccuacuuac

SEQ ID NO: 4619 - RNA, 19 nt, Artificial Sequence
  Description of Artificial Sequence: Synthetic oligonucleotide
uaaguaggccaaguuccuc

SEQ ID NO: 4620 - RNA, 19 nt, Artificial Sequence
  Description of Artificial Sequence: Synthetic oligonucleotide
gaggaacuuggccuacuua

SEQ ID NO: 4621 - RNA, 19 nt, Artificial Sequence
  Description of Artificial Sequence: Synthetic oligonucleotide
uaggccaaguuccucgguu

SEQ ID NO: 4622 - RNA, 19 nt, Artificial Sequence
  Description of Artificial Sequence: Synthetic oligonucleotide
aaccgaggaacuuggccua

SEQ ID NO: 4623 - RNA, 19 nt, Artificial Sequence
  Description of Artificial Sequence: Synthetic oligonucleotide
aggccaaguuccucgguuc

SEQ ID NO: 4624 - RNA, 19 nt, Artificial Sequence
  Description of Artificial Sequence: Synthetic oligonucleotide
gaaccgaggaacuuggccu

SEQ ID NO: 4625 - RNA, 19 nt, Artificial Sequence
  Description of Artificial Sequence: Synthetic oligonucleotide
ggccaaguuccucgguucc

SEQ ID NO: 4626 - RNA, 19 nt, Artificial Sequence
  Description of Artificial Sequence: Synthetic oligonucleotide
ggaaccgaggaacuuggcc

SEQ ID NO: 4627 - RNA, 19 nt, Artificial Sequence
  Description of Artificial Sequence: Synthetic oligonucleotide
gccaaguuccucgguuccu

SEQ ID NO: 4628 - RNA, 19 nt, Artificial Sequence
  Description of Artificial Sequence: Synthetic oligonucleotide
aggaaccgaggaacuuggc

SEQ ID NO: 4629 - RNA, 19 nt, Artificial Sequence
  Description of Artificial Sequence: Synthetic oligonucleotide
ccaaguuccucgguuccua

SEQ ID NO: 4630 - RNA, 19 nt, Artificial Sequence
  Description of Artificial Sequence: Synthetic oligonucleotide
uaggaaccgaggaacuugg

SEQ ID NO: 4631 - RNA, 19 nt, Artificial Sequence
  Description of Artificial Sequence: Synthetic oligonucleotide
caaguuccucgguuccuau

SEQ ID NO: 4632 - RNA, 19 nt, Artificial Sequence
  Description of Artificial Sequence: Synthetic oligonucleotide
auaggaaccgaggaacuug

SEQ ID NO: 4633 - RNA, 19 nt, Artificial Sequence
  Description of Artificial Sequence: Synthetic oligonucleotide
aaguuccucgguuccuaua

SEQ ID NO: 4634 - RNA, 19 nt, Artificial Sequence
  Description of Artificial Sequence: Synthetic oligonucleotide
uauaggaaccgaggaacuu

SEQ ID NO: 4635 - RNA, 19 nt, Artificial Sequence
  Description of Artificial Sequence: Synthetic oligonucleotide
aguuccucgguuccuauag

SEQ ID NO: 4636 - RNA, 19 nt, Artificial Sequence
  Description of Artificial Sequence: Synthetic oligonucleotide
cuauaggaaccgaggaacu

SEQ ID NO: 4637 - RNA, 19 nt, Artificial Sequence
  Description of Artificial Sequence: Synthetic oligonucleotide
guuccucgguuccuauagc

SEQ ID NO: 4638 - RNA, 19 nt, Artificial Sequence
  Description of Artificial Sequence: Synthetic oligonucleotide
gcuauaggaaccgaggaac

SEQ ID NO: 4639 - RNA, 19 nt, Artificial Sequence
  Description of Artificial Sequence: Synthetic oligonucleotide
uuccucgguuccuauagca

SEQ ID NO: 4640 - RNA, 19 nt, Artificial Sequence
  Description of Artificial Sequence: Synthetic oligonucleotide
ugcuauaggaaccgaggaa

SEQ ID NO: 4641 - RNA, 19 nt, Artificial Sequence
  Description of Artificial Sequence: Synthetic oligonucleotide
uccucgguuccuauagcag

SEQ ID NO: 4642 - RNA, 19 nt, Artificial Sequence
  Description of Artificial Sequence: Synthetic oligonucleotide
cugcuauaggaaccgagga

SEQ ID NO: 4643 - RNA, 19 nt, Artificial Sequence
  Description of Artificial Sequence: Synthetic oligonucleotide
caguggcaacuugugauga

SEQ ID NO: 4644 - RNA, 19 nt, Artificial Sequence
  Description of Artificial Sequence: Synthetic oligonucleotide
ucaucacaaguugccacug

SEQ ID NO: 4645 - RNA, 19 nt, Artificial Sequence
  Description of Artificial Sequence: Synthetic oligonucleotide
aguggcaacuugugaugau

SEQ ID NO: 4646 - RNA, 19 nt, Artificial Sequence
  Description of Artificial Sequence: Synthetic oligonucleotide
aucaucacaaguugccacu

SEQ ID NO: 4647 - RNA, 19 nt, Artificial Sequence
  Description of Artificial Sequence: Synthetic oligonucleotide
guggcaacuugugaugaug

SEQ ID NO: 4648 - RNA, 19 nt, Artificial Sequence
  Description of Artificial Sequence: Synthetic oligonucleotide
caucaucacaaguugccac

SEQ ID NO: 4649 - RNA, 19 nt, Artificial Sequence
  Description of Artificial Sequence: Synthetic oligonucleotide
ggcaacuugugaugaugga

SEQ ID NO: 4650 - RNA, 19 nt, Artificial Sequence
  Description of Artificial Sequence: Synthetic oligonucleotide
uccaucaucacaaguugcc

SEQ ID NO: 4651 - RNA, 19 nt, Artificial Sequence
  Description of Artificial Sequence: Synthetic oligonucleotide
acuugugaugauggagcag

SEQ ID NO: 4652 - RNA, 19 nt, Artificial Sequence
  Description of Artificial Sequence: Synthetic oligonucleotide
cugcuccaucaucacaagu

SEQ ID NO: 4653 - RNA, 19 nt, Artificial Sequence
  Description of Artificial Sequence: Synthetic oligonucleotide
cuugugaugauggagcaga

SEQ ID NO: 4654 - RNA, 19 nt, Artificial Sequence
  Description of Artificial Sequence: Synthetic oligonucleotide
ucugcuccaucaucacaag

SEQ ID NO: 4655 - RNA, 19 nt, Artificial Sequence
  Description of Artificial Sequence: Synthetic oligonucleotide
gugaugauggagcagaggg

SEQ ID NO: 4656 - RNA, 19 nt, Artificial Sequence
  Description of Artificial Sequence: Synthetic oligonucleotide
cccucugcuccaucaucac

SEQ ID NO: 4657 - RNA, 19 nt, Artificial Sequence
  Description of Artificial Sequence: Synthetic oligonucleotide
ugaugauggagcagagggc

SEQ ID NO: 4658 - RNA, 19 nt, Artificial Sequence
  Description of Artificial Sequence: Synthetic oligonucleotide
gcccucugcuccaucauca

SEQ ID NO: 4659 - RNA, 19 nt, Artificial Sequence
  Description of Artificial Sequence: Synthetic oligonucleotide
uggagcagagggcugaagu

SEQ ID NO: 4660 - RNA, 19 nt, Artificial Sequence
  Description of Artificial Sequence: Synthetic oligonucleotide
acuucagcccucugcucca

SEQ ID NO: 4661 - RNA, 19 nt, Artificial Sequence
  Description of Artificial Sequence: Synthetic oligonucleotide
ggagcagagggcugaaguc

SEQ ID NO: 4662 - RNA, 19 nt, Artificial Sequence
  Description of Artificial Sequence: Synthetic oligonucleotide
gacuucagcccucugcucc

SEQ ID NO: 4663 - RNA, 19 nt, Artificial Sequence
  Description of Artificial Sequence: Synthetic oligonucleotide
gagcagagggcugaaguca

SEQ ID NO: 4664 - RNA, 19 nt, Artificial Sequence
  Description of Artificial Sequence: Synthetic oligonucleotide
ugacuucagcccucugcuc

SEQ ID NO: 4665 - RNA, 19 nt, Artificial Sequence
  Description of Artificial Sequence: Synthetic oligonucleotide
cuaaaagcagcggaguggg

SEQ ID NO: 4666 - RNA, 19 nt, Artificial Sequence
  Description of Artificial Sequence: Synthetic oligonucleotide
cccacuccgcugcuuuuag

SEQ ID NO: 4667 - RNA, 19 nt, Artificial Sequence
  Description of Artificial Sequence: Synthetic oligonucleotide
uaaaagcagcggagugggc

SEQ ID NO: 4668 - RNA, 19 nt, Artificial Sequence
  Description of Artificial Sequence: Synthetic oligonucleotide
gcccacuccgcugcuuuua

SEQ ID NO: 4669 - RNA, 19 nt, Artificial Sequence
  Description of Artificial Sequence: Synthetic oligonucleotide
aaaagcagcggagugggcc

SEQ ID NO: 4670 - RNA, 19 nt, Artificial Sequence
  Description of Artificial Sequence: Synthetic oligonucleotide
ggcccacuccgcugcuuuu

SEQ ID NO: 4671 - RNA, 19 nt, Artificial Sequence
  Description of Artificial Sequence: Synthetic oligonucleotide
aaagcagcggagugggccu

SEQ ID NO: 4672 - RNA, 19 nt, Artificial Sequence
  Description of Artificial Sequence: Synthetic oligonucleotide
aggcccacuccgcugcuuu

SEQ ID NO: 4673 - RNA, 19 nt, Artificial Sequence
  Description of Artificial Sequence: Synthetic oligonucleotide
aagcagcggagugggccua

SEQ ID NO: 4674 - RNA, 19 nt, Artificial Sequence
  Description of Artificial Sequence: Synthetic oligonucleotide
uaggcccacuccgcugcuu

SEQ ID NO: 4675 - RNA, 19 nt, Artificial Sequence
  Description of Artificial Sequence: Synthetic oligonucleotide
agcagcggagugggccuaa

SEQ ID NO: 4676 - RNA, 19 nt, Artificial Sequence
  Description of Artificial Sequence: Synthetic oligonucleotide
uuaggcccacuccgcugcu

SEQ ID NO: 4677 - RNA, 19 nt, Artificial Sequence
  Description of Artificial Sequence: Synthetic oligonucleotide
gcagcggagugggccuaau

SEQ ID NO: 4678 - RNA, 19 nt, Artificial Sequence
  Description of Artificial Sequence: Synthetic oligonucleotide
auuaggcccacuccgcugc

SEQ ID NO: 4679 - RNA, 19 nt, Artificial Sequence
  Description of Artificial Sequence: Synthetic oligonucleotide
cagcggagugggccuaaug

SEQ ID NO: 4680 - RNA, 19 nt, Artificial Sequence
  Description of Artificial Sequence: Synthetic oligonucleotide
cauuaggcccacuccgcug

SEQ ID NO: 4681 - RNA, 19 nt, Artificial Sequence
  Description of Artificial Sequence: Synthetic oligonucleotide
agcggagugggccuaauga

SEQ ID NO: 4682 - RNA, 19 nt, Artificial Sequence
  Description of Artificial Sequence: Synthetic oligonucleotide
ucauuaggcccacuccgcu

SEQ ID NO: 4683 - RNA, 19 nt, Artificial Sequence
  Description of Artificial Sequence: Synthetic oligonucleotide
gcggagugggccuaaugag

SEQ ID NO: 4684 - RNA, 19 nt, Artificial Sequence
  Description of Artificial Sequence: Synthetic oligonucleotide
cucauuaggcccacuccgc

SEQ ID NO: 4685 - RNA, 19 nt, Artificial Sequence
  Description of Artificial Sequence: Synthetic oligonucleotide
agugggccuaaugagcucu

SEQ ID NO: 4686 - RNA, 19 nt, Artificial Sequence
  Description of Artificial Sequence: Synthetic oligonucleotide
agagcucauuaggcccacu

SEQ ID NO: 4687 - RNA, 19 nt, Artificial Sequence
  Description of Artificial Sequence: Synthetic oligonucleotide
gugggccuaaugagcucug

SEQ ID NO: 4688 - RNA, 19 nt, Artificial Sequence
  Description of Artificial Sequence: Synthetic oligonucleotide
cagagcucauuaggcccac

SEQ ID NO: 4689 - RNA, 19 nt, Artificial Sequence
  Description of Artificial Sequence: Synthetic oligonucleotide
ugggccuaaugagcucugg

SEQ ID NO: 4690 - RNA, 19 nt, Artificial Sequence
  Description of Artificial Sequence: Synthetic oligonucleotide
ccagagcucauuaggccca

SEQ ID NO: 4691 - RNA, 19 nt, Artificial Sequence
  Description of Artificial Sequence: Synthetic oligonucleotide
gggccuaaugagcucuggu

SEQ ID NO: 4692 - RNA, 19 nt, Artificial Sequence
  Description of Artificial Sequence: Synthetic oligonucleotide
accagagcucauuaggccc

SEQ ID NO: 4693 - RNA, 19 nt, Artificial Sequence
  Description of Artificial Sequence: Synthetic oligonucleotide
ggccuaaugagcucugguc

SEQ ID NO: 4694 - RNA, 19 nt, Artificial Sequence
  Description of Artificial Sequence: Synthetic oligonucleotide
gaccagagcucauuaggcc

SEQ ID NO: 4695 - RNA, 19 nt, Artificial Sequence
  Description of Artificial Sequence: Synthetic oligonucleotide
gccuaaugagcucugguca

SEQ ID NO: 4696 - RNA, 19 nt, Artificial Sequence
  Description of Artificial Sequence: Synthetic oligonucleotide
ugaccagagcucauuaggc

SEQ ID NO: 4697 - RNA, 19 nt, Artificial Sequence
  Description of Artificial Sequence: Synthetic oligonucleotide
ccuaaugagcucuggucaa

SEQ ID NO: 4698 - RNA, 19 nt, Artificial Sequence
  Description of Artificial Sequence: Synthetic oligonucleotide
uugaccagagcucauuagg

SEQ ID NO: 4699 - RNA, 19 nt, Artificial Sequence
  Description of Artificial Sequence: Synthetic oligonucleotide
cuaaugagcucuggucaau

SEQ ID NO: 4700 - RNA, 19 nt, Artificial Sequence
  Description of Artificial Sequence: Synthetic oligonucleotide
auugaccagagcucauuag

SEQ ID NO: 4701 - RNA, 19 nt, Artificial Sequence
  Description of Artificial Sequence: Synthetic oligonucleotide
uaaugagcucuggucaauu

SEQ ID NO: 4702 - RNA, 19 nt, Artificial Sequence
  Description of Artificial Sequence: Synthetic oligonucleotide
aauugaccagagcucauua

SEQ ID NO: 4703 - RNA, 19 nt, Artificial Sequence
  Description of Artificial Sequence: Synthetic oligonucleotide
aaugagcucuggucaauuu

SEQ ID NO: 4704 - RNA, 19 nt, Artificial Sequence
  Description of Artificial Sequence: Synthetic oligonucleotide
aaauugaccagagcucauu

SEQ ID NO: 4705 - RNA, 19 nt, Artificial Sequence
  Description of Artificial Sequence: Synthetic oligonucleotide
augagcucuggucaauuug

SEQ ID NO: 4706 - RNA, 19 nt, Artificial Sequence
  Description of Artificial Sequence: Synthetic oligonucleotide
caaauugaccagagcucau

SEQ ID NO: 4707 - RNA, 19 nt, Artificial Sequence
  Description of Artificial Sequence: Synthetic oligonucleotide
ugagcucuggucaauuugu

SEQ ID NO: 4708 - RNA, 19 nt, Artificial Sequence
  Description of Artificial Sequence: Synthetic oligonucleotide
acaaauugaccagagcuca

SEQ ID NO: 4709 - RNA, 19 nt, Artificial Sequence
  Description of Artificial Sequence: Synthetic oligonucleotide
cuggucaauuuguucauuu

SEQ ID NO: 4710 - RNA, 19 nt, Artificial Sequence
  Description of Artificial Sequence: Synthetic oligonucleotide
aaaugaacaaauugaccag

SEQ ID NO: 4711 - RNA, 19 nt, Artificial Sequence
  Description of Artificial Sequence: Synthetic oligonucleotide
caauuuguucauuuuccac

SEQ ID NO: 4712 - RNA, 19 nt, Artificial Sequence
  Description of Artificial Sequence: Synthetic oligonucleotide
guggaaaaugaacaaauug

SEQ ID NO: 4713 - RNA, 19 nt, Artificial Sequence
  Description of Artificial Sequence: Synthetic oligonucleotide
agugagcuuuucuauggga

SEQ ID NO: 4714 - RNA, 19 nt, Artificial Sequence
  Description of Artificial Sequence: Synthetic oligonucleotide
ucccauagaaaagcucacu

SEQ ID NO: 4715 - RNA, 19 nt, Artificial Sequence
  Description of Artificial Sequence: Synthetic oligonucleotide
agcuuuucuaugggagcag

SEQ ID NO: 4716 - RNA, 19 nt, Artificial Sequence
  Description of Artificial Sequence: Synthetic oligonucleotide
cugcucccauagaaaagcu

SEQ ID NO: 4717 - RNA, 19 nt, Artificial Sequence
  Description of Artificial Sequence: Synthetic oligonucleotide
gaauucagaagcuaguaug

SEQ ID NO: 4718 - RNA, 19 nt, Artificial Sequence
  Description of Artificial Sequence: Synthetic oligonucleotide
cauacuagcuucugaauuc

SEQ ID NO: 4719 - RNA, 19 nt, Artificial Sequence
  Description of Artificial Sequence: Synthetic oligonucleotide
auucagaagcuaguaugga

SEQ ID NO: 4720 - RNA, 19 nt, Artificial Sequence
  Description of Artificial Sequence: Synthetic oligonucleotide
uccauacuagcuucugaau

SEQ ID NO: 4721 - RNA, 19 nt, Artificial Sequence
  Description of Artificial Sequence: Synthetic oligonucleotide
uucagaagcuaguauggaa

SEQ ID NO: 4722 - RNA, 19 nt, Artificial Sequence
  Description of Artificial Sequence: Synthetic oligonucleotide
uuccauacuagcuucugaa

SEQ ID NO: 4723 - RNA, 19 nt, Artificial Sequence
  Description of Artificial Sequence: Synthetic oligonucleotide
aaaggugauuugugugaca

SEQ ID NO: 4724 - RNA, 19 nt, Artificial Sequence
  Description of Artificial Sequence: Synthetic oligonucleotide
ugucacacaaaucaccuuu

SEQ ID NO: 4725 - RNA, 19 nt, Artificial Sequence
  Description of Artificial Sequence: Synthetic oligonucleotide
auucugauucugccacuuc

SEQ ID NO: 4726 - RNA, 19 nt, Artificial Sequence
  Description of Artificial Sequence: Synthetic oligonucleotide
gaaguggcagaaucagaau

SEQ ID NO: 4727 - RNA, 19 nt, Artificial Sequence
  Description of Artificial Sequence: Synthetic oligonucleotide
auucugccacuuccugccu

SEQ ID NO: 4728 - RNA, 19 nt, Artificial Sequence
  Description of Artificial Sequence: Synthetic oligonucleotide
aggcaggaaguggcagaau

SEQ ID NO: 4729 - RNA, 19 nt, Artificial Sequence
  Description of Artificial Sequence: Synthetic oligonucleotide
gccacuuccugccugucaa

SEQ ID NO: 4730 - RNA, 19 nt, Artificial Sequence
  Description of Artificial Sequence: Synthetic oligonucleotide
uugacaggcaggaaguggc

SEQ ID NO: 4731 - RNA, 19 nt, Artificial Sequence
  Description of Artificial Sequence: Synthetic oligonucleotide
ccacuuccugccugucaaa

SEQ ID NO: 4732 - RNA, 19 nt, Artificial Sequence
  Description of Artificial Sequence: Synthetic oligonucleotide
uuugacaggcaggaagugg

SEQ ID NO: 4733 - RNA, 19 nt, Artificial Sequence
  Description of Artificial Sequence: Synthetic oligonucleotide
aaccuugggaaguuguuca

SEQ ID NO: 4734 - RNA, 19 nt, Artificial Sequence
  Description of Artificial Sequence: Synthetic oligonucleotide
ugaacaacuucccaagguu

SEQ ID NO: 4735 - RNA, 19 nt, Artificial Sequence
  Description of Artificial Sequence: Synthetic oligonucleotide
accuugggaaguuguucaa

SEQ ID NO: 4736 - RNA, 19 nt, Artificial Sequence
  Description of Artificial Sequence: Synthetic oligonucleotide
uugaacaacuucccaaggu

SEQ ID NO: 4737 - RNA, 19 nt, Artificial Sequence
  Description of Artificial Sequence: Synthetic oligonucleotide
ccuugggaaguuguucaac

SEQ ID NO: 4738 - RNA, 19 nt, Artificial Sequence
  Description of Artificial Sequence: Synthetic oligonucleotide
guugaacaacuucccaagg

SEQ ID NO: 4739 - RNA, 19 nt, Artificial Sequence
  Description of Artificial Sequence: Synthetic oligonucleotide
gggaaguuguucaaccuac

SEQ ID NO: 4740 - RNA, 19 nt, Artificial Sequence
  Description of Artificial Sequence: Synthetic oligonucleotide
guagguugaacaacuuccc

SEQ ID NO: 4741 - RNA, 19 nt, Artificial Sequence
  Description of Artificial Sequence: Synthetic oligonucleotide
ggaaguuguucaaccuacc

SEQ ID NO: 4742 - RNA, 19 nt, Artificial Sequence
  Description of Artificial Sequence: Synthetic oligonucleotide
gguagguugaacaacuucc

SEQ ID NO: 4743 - RNA, 19 nt, Artificial Sequence
  Description of Artificial Sequence: Synthetic oligonucleotide
gaaguuguucaaccuacca

SEQ ID NO: 4744 - RNA, 19 nt, Artificial Sequence
  Description of Artificial Sequence: Synthetic oligonucleotide
ugguagguugaacaacuuc

SEQ ID NO: 4745 - RNA, 19 nt, Artificial Sequence
  Description of Artificial Sequence: Synthetic oligonucleotide
aaguuguucaaccuaccaa

SEQ ID NO: 4746 - RNA, 19 nt, Artificial Sequence
  Description of Artificial Sequence: Synthetic oligonucleotide
uugguagguugaacaacuu

SEQ ID NO: 4747 - RNA, 19 nt, Artificial Sequence
  Description of Artificial Sequence: Synthetic oligonucleotide
aguuguucaaccuaccaaa

SEQ ID NO: 4748 - RNA, 19 nt, Artificial Sequence
  Description of Artificial Sequence: Synthetic oligonucleotide
uuugguagguugaacaacu

SEQ ID NO: 4749 - RNA, 19 nt, Artificial Sequence
  Description of Artificial Sequence: Synthetic oligonucleotide
guuguucaaccuaccaaaa

SEQ ID NO: 4750 - RNA, 19 nt, Artificial Sequence
  Description of Artificial Sequence: Synthetic oligonucleotide
uuuugguagguugaacaac

SEQ ID NO: 4751 - RNA, 19 nt, Artificial Sequence
  Description of Artificial Sequence: Synthetic oligonucleotide
gcaauaauaauacaucacc

SEQ ID NO: 4752 - RNA, 19 nt, Artificial Sequence
  Description of Artificial Sequence: Synthetic oligonucleotide
ggugauguauuauuauugc

SEQ ID NO: 4753 - RNA, 19 nt, Artificial Sequence
  Description of Artificial Sequence: Synthetic oligonucleotide
auaauaauacaucaccucc

SEQ ID NO: 4754 - RNA, 19 nt, Artificial Sequence
  Description of Artificial Sequence: Synthetic oligonucleotide
ggaggugauguauuauuau

SEQ ID NO: 4755 - RNA, 19 nt, Artificial Sequence
  Description of Artificial Sequence: Synthetic oligonucleotide
uaauacaucaccuccuagg

SEQ ID NO: 4756 - RNA, 19 nt, Artificial Sequence
  Description of Artificial Sequence: Synthetic oligonucleotide
ccuaggaggugauguauua

SEQ ID NO: 4757 - RNA, 19 nt, Artificial Sequence
  Description of Artificial Sequence: Synthetic oligonucleotide
aauacaucaccuccuaggg

SEQ ID NO: 4758 - RNA, 19 nt, Artificial Sequence
  Description of Artificial Sequence: Synthetic oligonucleotide
cccuaggaggugauguauu

SEQ ID NO: 4759 - RNA, 19 nt, Artificial Sequence
  Description of Artificial Sequence: Synthetic oligonucleotide
auacaucaccuccuagggu

SEQ ID NO: 4760 - RNA, 19 nt, Artificial Sequence
  Description of Artificial Sequence: Synthetic oligonucleotide
acccuaggaggugauguau

SEQ ID NO: 4761 - RNA, 19 nt, Artificial Sequence
  Description of Artificial Sequence: Synthetic oligonucleotide
uacaucaccuccuaggguu

SEQ ID NO: 4762 - RNA, 19 nt, Artificial Sequence
  Description of Artificial Sequence: Synthetic oligonucleotide
aacccuaggaggugaugua

SEQ ID NO: 4763 - RNA, 19 nt, Artificial Sequence
  Description of Artificial Sequence: Synthetic oligonucleotide
acaucaccuccuaggguug

SEQ ID NO: 4764 - RNA, 19 nt, Artificial Sequence
  Description of Artificial Sequence: Synthetic oligonucleotide
caacccuaggaggugaugu

SEQ ID NO: 4765 - RNA, 19 nt, Artificial Sequence
  Description of Artificial Sequence: Synthetic oligonucleotide
aaaggaguaagaggauaau

SEQ ID NO: 4766 - RNA, 19 nt, Artificial Sequence
  Description of Artificial Sequence: Synthetic oligonucleotide
auuauccucuuacuccuuu

SEQ ID NO: 4767 - RNA, 19 nt, Artificial Sequence
  Description of Artificial Sequence: Synthetic oligonucleotide
aaggaguaagaggauaaug

SEQ ID NO: 4768 - RNA, 19 nt, Artificial Sequence
  Description of Artificial Sequence: Synthetic oligonucleotide
cauuauccucuuacuccuu

SEQ ID NO: 4769 - RNA, 19 nt, Artificial Sequence
  Description of Artificial Sequence: Synthetic oligonucleotide
aguaagaggauaauguagg

SEQ ID NO: 4770 - RNA, 19 nt, Artificial Sequence
  Description of Artificial Sequence: Synthetic oligonucleotide
ccuacauuauccucuuacu

SEQ ID NO: 4771 - RNA, 19 nt, Artificial Sequence
  Description of Artificial Sequence: Synthetic oligonucleotide
guaagaggauaauguaggu

SEQ ID NO: 4772 - RNA, 19 nt, Artificial Sequence
  Description of Artificial Sequence: Synthetic oligonucleotide
accuacauuauccucuuac

SEQ ID NO: 4773 - RNA, 19 nt, Artificial Sequence
  Description of Artificial Sequence: Synthetic oligonucleotide
uaagaggauaauguaggua

SEQ ID NO: 4774 - RNA, 19 nt, Artificial Sequence
  Description of Artificial Sequence: Synthetic oligonucleotide
uaccuacauuauccucuua

SEQ ID NO: 4775 - RNA, 19 nt, Artificial Sequence
  Description of Artificial Sequence: Synthetic oligonucleotide
aagaggauaauguagguaa

SEQ ID NO: 4776 - RNA, 19 nt, Artificial Sequence
  Description of Artificial Sequence: Synthetic oligonucleotide
uuaccuacauuauccucuu

SEQ ID NO: 4777 - RNA, 19 nt, Artificial Sequence
  Description of Artificial Sequence: Synthetic oligonucleotide
agaggauaauguagguaaa

SEQ ID NO: 4778 - RNA, 19 nt, Artificial Sequence
  Description of Artificial Sequence: Synthetic oligonucleotide
uuuaccuacauuauccucu

SEQ ID NO: 4779 - RNA, 19 nt, Artificial Sequence
  Description of Artificial Sequence: Synthetic oligonucleotide
gaggauaauguagguaaag

SEQ ID NO: 4780 - RNA, 19 nt, Artificial Sequence
  Description of Artificial Sequence: Synthetic oligonucleotide
cuuuaccuacauuauccuc

SEQ ID NO: 4781 - RNA, 19 nt, Artificial Sequence
  Description of Artificial Sequence: Synthetic oligonucleotide
ggauaauguagguaaaguc

SEQ ID NO: 4782 - RNA, 19 nt, Artificial Sequence
  Description of Artificial Sequence: Synthetic oligonucleotide
gacuuuaccuacauuaucc

SEQ ID NO: 4783 - RNA, 19 nt, Artificial Sequence
  Description of Artificial Sequence: Synthetic oligonucleotide
auaauguagguaaaguccu

SEQ ID NO: 4784 - RNA, 19 nt, Artificial Sequence
  Description of Artificial Sequence: Synthetic oligonucleotide
aggacuuuaccuacauuau

SEQ ID NO: 4785 - RNA, 19 nt, Artificial Sequence
  Description of Artificial Sequence: Synthetic oligonucleotide
guagguaaaguccucauac

SEQ ID NO: 4786 - RNA, 19 nt, Artificial Sequence
  Description of Artificial Sequence: Synthetic oligonucleotide
guaugaggacuuuaccuac

SEQ ID NO: 4787 - RNA, 19 nt, Artificial Sequence
  Description of Artificial Sequence: Synthetic oligonucleotide
guaaaguccucauaccugg

SEQ ID NO: 4788 - RNA, 19 nt, Artificial Sequence
  Description of Artificial Sequence: Synthetic oligonucleotide
ccagguaugaggacuuuac

SEQ ID NO: 4789 - RNA, 19 nt, Artificial Sequence
  Description of Artificial Sequence: Synthetic oligonucleotide
uaaaguccucauaccuggc

SEQ ID NO: 4790 - RNA, 19 nt, Artificial Sequence
  Description of Artificial Sequence: Synthetic oligonucleotide
gccagguaugaggacuuua

SEQ ID NO: 4791 - RNA, 19 nt, Artificial Sequence
  Description of Artificial Sequence: Synthetic oligonucleotide
aaaguccucauaccuggca

SEQ ID NO: 4792 - RNA, 19 nt, Artificial Sequence
  Description of Artificial Sequence: Synthetic oligonucleotide
ugccagguaugaggacuuu

SEQ ID NO: 4793 - RNA, 19 nt, Artificial Sequence
  Description of Artificial Sequence: Synthetic oligonucleotide
aaguccucauaccuggcac

SEQ ID NO: 4794 - RNA, 19 nt, Artificial Sequence
  Description of Artificial Sequence: Synthetic oligonucleotide
gugccagguaugaggacuu

SEQ ID NO: 4795 - RNA, 19 nt, Artificial Sequence
  Description of Artificial Sequence: Synthetic oligonucleotide
aguccucauaccuggcaca

SEQ ID NO: 4796 - RNA, 19 nt, Artificial Sequence
  Description of Artificial Sequence: Synthetic oligonucleotide
ugugccagguaugaggacu

SEQ ID NO: 4797 - RNA, 19 nt, Artificial Sequence
  Description of Artificial Sequence: Synthetic oligonucleotide
guccucauaccuggcacag

SEQ ID NO: 4798 - RNA, 19 nt, Artificial Sequence
  Description of Artificial Sequence: Synthetic oligonucleotide
cugugccagguaugaggac

SEQ ID NO: 4799 - RNA, 19 nt, Artificial Sequence
  Description of Artificial Sequence: Synthetic oligonucleotide
uccucauaccuggcacaga

SEQ ID NO: 4800 - RNA, 19 nt, Artificial Sequence
  Description of Artificial Sequence: Synthetic oligonucleotide
ucugugccagguaugagga

SEQ ID NO: 4801 - RNA, 19 nt, Artificial Sequence
  Description of Artificial Sequence: Synthetic oligonucleotide
ucuugagggugugggaagu

SEQ ID NO: 4802 - RNA, 19 nt, Artificial Sequence
  Description of Artificial Sequence: Synthetic oligonucleotide
acuucccacacccucaaga

SEQ ID NO: 4803 - RNA, 19 nt, Artificial Sequence
  Description of Artificial Sequence: Synthetic oligonucleotide
cuugagggugugggaagug

SEQ ID NO: 4804 - RNA, 19 nt, Artificial Sequence
  Description of Artificial Sequence: Synthetic oligonucleotide
cacuucccacacccucaag

SEQ ID NO: 4805 - RNA, 19 nt, Artificial Sequence
  Description of Artificial Sequence: Synthetic oligonucleotide
uugagggugugggaaguga

SEQ ID NO: 4806 - RNA, 19 nt, Artificial Sequence
  Description of Artificial Sequence: Synthetic oligonucleotide
ucacuucccacacccucaa

SEQ ID NO: 4807 - RNA, 19 nt, Artificial Sequence
  Description of Artificial Sequence: Synthetic oligonucleotide
ugagggugugggaagugag

SEQ ID NO: 4808 - RNA, 19 nt, Artificial Sequence
  Description of Artificial Sequence: Synthetic oligonucleotide
cucacuucccacacccuca

SEQ ID NO: 4809 - RNA, 19 nt, Artificial Sequence
  Description of Artificial Sequence: Synthetic oligonucleotide
agggugugggaagugaggu

SEQ ID NO: 4810 - RNA, 19 nt, Artificial Sequence
  Description of Artificial Sequence: Synthetic oligonucleotide
accucacuucccacacccu

SEQ ID NO: 4811 - RNA, 19 nt, Artificial Sequence
  Description of Artificial Sequence: Synthetic oligonucleotide
gggugugggaagugaggug

SEQ ID NO: 4812 - RNA, 19 nt, Artificial Sequence
  Description of Artificial Sequence: Synthetic oligonucleotide
caccucacuucccacaccc

SEQ ID NO: 4813 - RNA, 19 nt, Artificial Sequence
  Description of Artificial Sequence: Synthetic oligonucleotide
gggaagugaggugcagcau

SEQ ID NO: 4814 - RNA, 19 nt, Artificial Sequence
  Description of Artificial Sequence: Synthetic oligonucleotide
augcugcaccucacuuccc

SEQ ID NO: 4815 - RNA, 19 nt, Artificial Sequence
  Description of Artificial Sequence: Synthetic oligonucleotide
ggaagugaggugcagcauu

SEQ ID NO: 4816 - RNA, 19 nt, Artificial Sequence
  Description of Artificial Sequence: Synthetic oligonucleotide
aaugcugcaccucacuucc

SEQ ID NO: 4817 - RNA, 19 nt, Artificial Sequence
  Description of Artificial Sequence: Synthetic oligonucleotide
gaagugaggugcagcauug

SEQ ID NO: 4818 - RNA, 19 nt, Artificial Sequence
  Description of Artificial Sequence: Synthetic oligonucleotide
caaugcugcaccucacuuc

SEQ ID NO: 4819 - RNA, 19 nt, Artificial Sequence
  Description of Artificial Sequence: Synthetic oligonucleotide
aagugaggugcagcauugu

SEQ ID NO: 4820 - RNA, 19 nt, Artificial Sequence
  Description of Artificial Sequence: Synthetic oligonucleotide
acaaugcugcaccucacuu

SEQ ID NO: 4821 - RNA, 19 nt, Artificial Sequence
  Description of Artificial Sequence: Synthetic oligonucleotide
agugaggugcagcauugua

SEQ ID NO: 4822 - RNA, 19 nt, Artificial Sequence
  Description of Artificial Sequence: Synthetic oligonucleotide
uacaaugcugcaccucacu

SEQ ID NO: 4823 - RNA, 19 nt, Artificial Sequence
  Description of Artificial Sequence: Synthetic oligonucleotide
gugaggugcagcauuguag

SEQ ID NO: 4824 - RNA, 19 nt, Artificial Sequence
  Description of Artificial Sequence: Synthetic oligonucleotide
cuacaaugcugcaccucac

SEQ ID NO: 4825 - RNA, 19 nt, Artificial Sequence
  Description of Artificial Sequence: Synthetic oligonucleotide
ugaggugcagcauuguaga

SEQ ID NO: 4826 - RNA, 19 nt, Artificial Sequence
  Description of Artificial Sequence: Synthetic oligonucleotide
ucuacaaugcugcaccuca

SEQ ID NO: 4827 - RNA, 19 nt, Artificial Sequence
  Description of Artificial Sequence: Synthetic oligonucleotide
gaggugcagcauuguagau

SEQ ID NO: 4828 - RNA, 19 nt, Artificial Sequence
  Description of Artificial Sequence: Synthetic oligonucleotide
aucuacaaugcugcaccuc

SEQ ID NO: 4829 - RNA, 19 nt, Artificial Sequence
  Description of Artificial Sequence: Synthetic oligonucleotide
aggugcagcauuguagaua

SEQ ID NO: 4830 - RNA, 19 nt, Artificial Sequence
  Description of Artificial Sequence: Synthetic oligonucleotide
uaucuacaaugcugcaccu

SEQ ID NO: 4831 - RNA, 19 nt, Artificial Sequence
  Description of Artificial Sequence: Synthetic oligonucleotide
ggugcagcauuguagauaa

SEQ ID NO: 4832 - RNA, 19 nt, Artificial Sequence
  Description of Artificial Sequence: Synthetic oligonucleotide
uuaucuacaaugcugcacc

SEQ ID NO: 4833 - RNA, 19 nt, Artificial Sequence
  Description of Artificial Sequence: Synthetic oligonucleotide
gugcagcauuguagauaag

SEQ ID NO: 4834 - RNA, 19 nt, Artificial Sequence
  Description of Artificial Sequence: Synthetic oligonucleotide
cuuaucuacaaugcugcac

SEQ ID NO: 4835 - RNA, 19 nt, Artificial Sequence
  Description of Artificial Sequence: Synthetic oligonucleotide
ugcagcauuguagauaaga

SEQ ID NO: 4836 - RNA, 19 nt, Artificial Sequence
  Description of Artificial Sequence: Synthetic oligonucleotide
ucuuaucuacaaugcugca

SEQ ID NO: 4837 - RNA, 19 nt, Artificial Sequence
  Description of Artificial Sequence: Synthetic oligonucleotide
gcauuguagauaagacaga

SEQ ID NO: 4838 - RNA, 19 nt, Artificial Sequence
  Description of Artificial Sequence: Synthetic oligonucleotide
ucugucuuaucuacaaugc

SEQ ID NO: 4839 - RNA, 19 nt, Artificial Sequence
  Description of Artificial Sequence: Synthetic oligonucleotide
cauuguagauaagacagaa

SEQ ID NO: 4840 - RNA, 19 nt, Artificial Sequence
  Description of Artificial Sequence: Synthetic oligonucleotide
uucugucuuaucuacaaug

SEQ ID NO: 4841 - RNA, 19 nt, Artificial Sequence
  Description of Artificial Sequence: Synthetic oligonucleotide
auuguagauaagacagaag

SEQ ID NO: 4842 - RNA, 19 nt, Artificial Sequence
  Description of Artificial Sequence: Synthetic oligonucleotide
cuucugucuuaucuacaau

SEQ ID NO: 4843 - RNA, 19 nt, Artificial Sequence
  Description of Artificial Sequence: Synthetic oligonucleotide
auaagacagaaggguggac

SEQ ID NO: 4844 - RNA, 19 nt, Artificial Sequence
  Description of Artificial Sequence: Synthetic oligonucleotide
guccacccuucugucuuau

SEQ ID NO: 4845 - RNA, 19 nt, Artificial Sequence
  Description of Artificial Sequence: Synthetic oligonucleotide
uaagacagaaggguggacu

SEQ ID NO: 4846 - RNA, 19 nt, Artificial Sequence
  Description of Artificial Sequence: Synthetic oligonucleotide
aguccacccuucugucuua

SEQ ID NO: 4847 - RNA, 19 nt, Artificial Sequence
  Description of Artificial Sequence: Synthetic oligonucleotide
aaccuggcuugcuuuccaa

SEQ ID NO: 4848 - RNA, 19 nt, Artificial Sequence
  Description of Artificial Sequence: Synthetic oligonucleotide
uuggaaagcaagccagguu

SEQ ID NO: 4849 - RNA, 19 nt, Artificial Sequence
  Description of Artificial Sequence: Synthetic oligonucleotide
ccuggcuugcuuuccaauu

SEQ ID NO: 4850 - RNA, 19 nt, Artificial Sequence
  Description of Artificial Sequence: Synthetic oligonucleotide
aauuggaaagcaagccagg

SEQ ID NO: 4851 - RNA, 19 nt, Artificial Sequence
  Description of Artificial Sequence: Synthetic oligonucleotide
accagaagugacuuggagg

SEQ ID NO: 4852 - RNA, 19 nt, Artificial Sequence
  Description of Artificial Sequence: Synthetic oligonucleotide
ccuccaagucacuucuggu

SEQ ID NO: 4853 - RNA, 19 nt, Artificial Sequence
  Description of Artificial Sequence: Synthetic oligonucleotide
ccagaagugacuuggaggg

SEQ ID NO: 4854 - RNA, 19 nt, Artificial Sequence
  Description of Artificial Sequence: Synthetic oligonucleotide
cccuccaagucacuucugg

SEQ ID NO: 4855 - RNA, 19 nt, Artificial Sequence
  Description of Artificial Sequence: Synthetic oligonucleotide
agaugccaaugacauggua

SEQ ID NO: 4856 - RNA, 19 nt, Artificial Sequence
  Description of Artificial Sequence: Synthetic oligonucleotide
uaccaugucauuggcaucu

SEQ ID NO: 4857 - RNA, 19 nt, Artificial Sequence
  Description of Artificial Sequence: Synthetic oligonucleotide
gaugccaaugacaugguag

SEQ ID NO: 4858 - RNA, 19 nt, Artificial Sequence
  Description of Artificial Sequence: Synthetic oligonucleotide
cuaccaugucauuggcauc

SEQ ID NO: 4859 - RNA, 19 nt, Artificial Sequence
  Description of Artificial Sequence: Synthetic oligonucleotide
augccaaugacaugguagg

SEQ ID NO: 4860 - RNA, 19 nt, Artificial Sequence
  Description of Artificial Sequence: Synthetic oligonucleotide
ccuaccaugucauuggcau

SEQ ID NO: 4861 - RNA, 19 nt, Artificial Sequence
  Description of Artificial Sequence: Synthetic oligonucleotide
caaugacaugguaggagca

SEQ ID NO: 4862 - RNA, 19 nt, Artificial Sequence
  Description of Artificial Sequence: Synthetic oligonucleotide
ugcuccuaccaugucauug

SEQ ID NO: 4863 - RNA, 19 nt, Artificial Sequence
  Description of Artificial Sequence: Synthetic oligonucleotide
aaugacaugguaggagcaa

SEQ ID NO: 4864 - RNA, 19 nt, Artificial Sequence
  Description of Artificial Sequence: Synthetic oligonucleotide
uugcuccuaccaugucauu

SEQ ID NO: 4865 - RNA, 19 nt, Artificial Sequence
  Description of Artificial Sequence: Synthetic oligonucleotide
augacaugguaggagcaaa

SEQ ID NO: 4866 - RNA, 19 nt, Artificial Sequence
  Description of Artificial Sequence: Synthetic oligonucleotide
uuugcuccuaccaugucau

SEQ ID NO: 4867 - RNA, 19 nt, Artificial Sequence
  Description of Artificial Sequence: Synthetic oligonucleotide
ugacaugguaggagcaaag

SEQ ID NO: 4868 - RNA, 19 nt, Artificial Sequence
  Description of Artificial Sequence: Synthetic oligonucleotide
cuuugcuccuaccauguca

SEQ ID NO: 4869 - RNA, 19 nt, Artificial Sequence
  Description of Artificial Sequence: Synthetic oligonucleotide
gacaugguaggagcaaaga

SEQ ID NO: 4870 - RNA, 19 nt, Artificial Sequence
  Description of Artificial Sequence: Synthetic oligonucleotide
ucuuugcuccuaccauguc

SEQ ID NO: 4871 - RNA, 19 nt, Artificial Sequence
  Description of Artificial Sequence: Synthetic oligonucleotide
aaaaggucagccucuagcu

SEQ ID NO: 4872 - RNA, 19 nt, Artificial Sequence
  Description of Artificial Sequence: Synthetic oligonucleotide
agcuagaggcugaccuuuu

SEQ ID NO: 4873 - RNA, 19 nt, Artificial Sequence
  Description of Artificial Sequence: Synthetic oligonucleotide
aaaggucagccucuagcua

SEQ ID NO: 4874 - RNA, 19 nt, Artificial Sequence
  Description of Artificial Sequence: Synthetic oligonucleotide
uagcuagaggcugaccuuu

SEQ ID NO: 4875 - RNA, 19 nt, Artificial Sequence
  Description of Artificial Sequence: Synthetic oligonucleotide
aggucagccucuagcuagg

SEQ ID NO: 4876 - RNA, 19 nt, Artificial Sequence
  Description of Artificial Sequence: Synthetic oligonucleotide
ccuagcuagaggcugaccu

SEQ ID NO: 4877 - RNA, 19 nt, Artificial Sequence
  Description of Artificial Sequence: Synthetic oligonucleotide
ggucagccucuagcuagga

SEQ ID NO: 4878 - RNA, 19 nt, Artificial Sequence
  Description of Artificial Sequence: Synthetic oligonucleotide
uccuagcuagaggcugacc

SEQ ID NO: 4879 - RNA, 19 nt, Artificial Sequence
  Description of Artificial Sequence: Synthetic oligonucleotide
gucagccucuagcuaggau

SEQ ID NO: 4880 - RNA, 19 nt, Artificial Sequence
  Description of Artificial Sequence: Synthetic oligonucleotide
auccuagcuagaggcugac

SEQ ID NO: 4881 - RNA, 19 nt, Artificial Sequence
  Description of Artificial Sequence: Synthetic oligonucleotide
cagccucuagcuaggaucc

SEQ ID NO: 4882 - RNA, 19 nt, Artificial Sequence
  Description of Artificial Sequence: Synthetic oligonucleotide
ggauccuagcuagaggcug

SEQ ID NO: 4883 - RNA, 19 nt, Artificial Sequence
  Description of Artificial Sequence: Synthetic oligonucleotide
agccucuagcuaggauccc

SEQ ID NO: 4884 - RNA, 19 nt, Artificial Sequence
  Description of Artificial Sequence: Synthetic oligonucleotide
gggauccuagcuagaggcu

SEQ ID NO: 4885 - RNA, 19 nt, Artificial Sequence
  Description of Artificial Sequence: Synthetic oligonucleotide
agagcugcaaccuuuagga

SEQ ID NO: 4886 - RNA, 19 nt, Artificial Sequence
  Description of Artificial Sequence: Synthetic oligonucleotide
uccuaaagguugcagcucu

SEQ ID NO: 4887 - RNA, 19 nt, Artificial Sequence
  Description of Artificial Sequence: Synthetic oligonucleotide
gagcugcaaccuuuaggag

SEQ ID NO: 4888 - RNA, 19 nt, Artificial Sequence
  Description of Artificial Sequence: Synthetic oligonucleotide
cuccuaaagguugcagcuc

SEQ ID NO: 4889 - RNA, 19 nt, Artificial Sequence
  Description of Artificial Sequence: Synthetic oligonucleotide
agcugcaaccuuuaggagg

SEQ ID NO: 4890 - RNA, 19 nt, Artificial Sequence
  Description of Artificial Sequence: Synthetic oligonucleotide
ccuccuaaagguugcagcu

SEQ ID NO: 4891 - RNA, 19 nt, Artificial Sequence
  Description of Artificial Sequence: Synthetic oligonucleotide
uuuaggagguaucaaagug

SEQ ID NO: 4892 - RNA, 19 nt, Artificial Sequence
  Description of Artificial Sequence: Synthetic oligonucleotide
cacuuugauaccuccuaaa

SEQ ID NO: 4893 - RNA, 19 nt, Artificial Sequence
  Description of Artificial Sequence: Synthetic oligonucleotide
uuaggagguaucaaagugc

SEQ ID NO: 4894 - RNA, 19 nt, Artificial Sequence
  Description of Artificial Sequence: Synthetic oligonucleotide
gcacuuugauaccuccuaa

SEQ ID NO: 4895 - RNA, 19 nt, Artificial Sequence
  Description of Artificial Sequence: Synthetic oligonucleotide
uaggagguaucaaagugcc

SEQ ID NO: 4896 - RNA, 19 nt, Artificial Sequence
  Description of Artificial Sequence: Synthetic oligonucleotide
ggcacuuugauaccuccua

SEQ ID NO: 4897 - RNA, 19 nt, Artificial Sequence
  Description of Artificial Sequence: Synthetic oligonucleotide
gucaaagugggacaucgac

SEQ ID NO: 4898 - RNA, 19 nt, Artificial Sequence
  Description of Artificial Sequence: Synthetic oligonucleotide
gucgaugucccacuuugac

SEQ ID NO: 4899 - RNA, 19 nt, Artificial Sequence
  Description of Artificial Sequence: Synthetic oligonucleotide
caucgaccaaugucuagag

SEQ ID NO: 4900 - RNA, 19 nt, Artificial Sequence
  Description of Artificial Sequence: Synthetic oligonucleotide
cucuagacauuggucgaug

SEQ ID NO: 4901 - RNA, 19 nt, Artificial Sequence
  Description of Artificial Sequence: Synthetic oligonucleotide
aucgaccaaugucuagagc

SEQ ID NO: 4902 - RNA, 19 nt, Artificial Sequence
  Description of Artificial Sequence: Synthetic oligonucleotide
gcucuagacauuggucgau

SEQ ID NO: 4903 - RNA, 19 nt, Artificial Sequence
  Description of Artificial Sequence: Synthetic oligonucleotide
accaaugucuagagccaac

SEQ ID NO: 4904 - RNA, 19 nt, Artificial Sequence
  Description of Artificial Sequence: Synthetic oligonucleotide
guuggcucuagacauuggu

SEQ ID NO: 4905 - RNA, 19 nt, Artificial Sequence
  Description of Artificial Sequence: Synthetic oligonucleotide
caaugucuagagccaacug

SEQ ID NO: 4906 - RNA, 19 nt, Artificial Sequence
  Description of Artificial Sequence: Synthetic oligonucleotide
caguuggcucuagacauug

SEQ ID NO: 4907 - RNA, 19 nt, Artificial Sequence
  Description of Artificial Sequence: Synthetic oligonucleotide
aaugucuagagccaacuga

SEQ ID NO: 4908 - RNA, 19 nt, Artificial Sequence
  Description of Artificial Sequence: Synthetic oligonucleotide
ucaguuggcucuagacauu

SEQ ID NO: 4909 - RNA, 19 nt, Artificial Sequence
  Description of Artificial Sequence: Synthetic oligonucleotide
augucuagagccaacugau

SEQ ID NO: 4910 - RNA, 19 nt, Artificial Sequence
  Description of Artificial Sequence: Synthetic oligonucleotide
aucaguuggcucuagacau

SEQ ID NO: 4911 - RNA, 19 nt, Artificial Sequence
  Description of Artificial Sequence: Synthetic oligonucleotide
ugucuagagccaacugaug

SEQ ID NO: 4912 - RNA, 19 nt, Artificial Sequence
  Description of Artificial Sequence: Synthetic oligonucleotide
caucaguuggcucuagaca

SEQ ID NO: 4913 - RNA, 19 nt, Artificial Sequence
  Description of Artificial Sequence: Synthetic oligonucleotide
gucuagagccaacugaugg

SEQ ID NO: 4914 - RNA, 19 nt, Artificial Sequence
  Description of Artificial Sequence: Synthetic oligonucleotide
ccaucaguuggcucuagac

SEQ ID NO: 4915 - RNA, 19 nt, Artificial Sequence
  Description of Artificial Sequence: Synthetic oligonucleotide
ucuagagccaacugaugga

SEQ ID NO: 4916 - RNA, 19 nt, Artificial Sequence
  Description of Artificial Sequence: Synthetic oligonucleotide
uccaucaguuggcucuaga

SEQ ID NO: 4917 - RNA, 19 nt, Artificial Sequence
  Description of Artificial Sequence: Synthetic oligonucleotide
cuagagccaacugauggau

SEQ ID NO: 4918 - RNA, 19 nt, Artificial Sequence
  Description of Artificial Sequence: Synthetic oligonucleotide
auccaucaguuggcucuag

SEQ ID NO: 4919 - RNA, 19 nt, Artificial Sequence
  Description of Artificial Sequence: Synthetic oligonucleotide
uagagccaacugauggaug

SEQ ID NO: 4920 - RNA, 19 nt, Artificial Sequence
  Description of Artificial Sequence: Synthetic oligonucleotide
cauccaucaguuggcucua

SEQ ID NO: 4921 - RNA, 19 nt, Artificial Sequence
  Description of Artificial Sequence: Synthetic oligonucleotide
agagccaacugauggaugu

SEQ ID NO: 4922 - RNA, 19 nt, Artificial Sequence
  Description of Artificial Sequence: Synthetic oligonucleotide
acauccaucaguuggcucu

SEQ ID NO: 4923 - RNA, 19 nt, Artificial Sequence
  Description of Artificial Sequence: Synthetic oligonucleotide
gagccaacugauggauguu

SEQ ID NO: 4924 - RNA, 19 nt, Artificial Sequence
  Description of Artificial Sequence: Synthetic oligonucleotide
aacauccaucaguuggcuc

SEQ ID NO: 4925 - RNA, 19 nt, Artificial Sequence
  Description of Artificial Sequence: Synthetic oligonucleotide
aacugauggauguugggca

SEQ ID NO: 4926 - RNA, 19 nt, Artificial Sequence
  Description of Artificial Sequence: Synthetic oligonucleotide
ugcccaacauccaucaguu

SEQ ID NO: 4927 - RNA, 19 nt, Artificial Sequence
  Description of Artificial Sequence: Synthetic oligonucleotide
uggauguugggcagcuaaa

SEQ ID NO: 4928 - RNA, 19 nt, Artificial Sequence
  Description of Artificial Sequence: Synthetic oligonucleotide
uuuagcugcccaacaucca

SEQ ID NO: 4929 - RNA, 19 nt, Artificial Sequence
  Description of Artificial Sequence: Synthetic oligonucleotide
ggauguugggcagcuaaag

SEQ ID NO: 4930 - RNA, 19 nt, Artificial Sequence
  Description of Artificial Sequence: Synthetic oligonucleotide
cuuuagcugcccaacaucc

SEQ ID NO: 4931 - RNA, 19 nt, Artificial Sequence
  Description of Artificial Sequence: Synthetic oligonucleotide
gauguugggcagcuaaaga

SEQ ID NO: 4932 - RNA, 19 nt, Artificial Sequence
  Description of Artificial Sequence: Synthetic oligonucleotide
ucuuuagcugcccaacauc

SEQ ID NO: 4933 - RNA, 19 nt, Artificial Sequence
  Description of Artificial Sequence: Synthetic oligonucleotide
uugggcagcuaaagaggga

SEQ ID NO: 4934 - RNA, 19 nt, Artificial Sequence
  Description of Artificial Sequence: Synthetic oligonucleotide
ucccucuuuagcugcccaa

SEQ ID NO: 4935 - RNA, 19 nt, Artificial Sequence
  Description of Artificial Sequence: Synthetic oligonucleotide
ugggcagcuaaagagggaa

SEQ ID NO: 4936 - RNA, 19 nt, Artificial Sequence
  Description of Artificial Sequence: Synthetic oligonucleotide
uucccucuuuagcugccca

SEQ ID NO: 4937 - RNA, 19 nt, Artificial Sequence
  Description of Artificial Sequence: Synthetic oligonucleotide
gggcagcuaaagagggaag

SEQ ID NO: 4938 - RNA, 19 nt, Artificial Sequence
  Description of Artificial Sequence: Synthetic oligonucleotide
cuucccucuuuagcugccc

SEQ ID NO: 4939 - RNA, 19 nt, Artificial Sequence
  Description of Artificial Sequence: Synthetic oligonucleotide
ggcagcuaaagagggaagg

SEQ ID NO: 4940 - RNA, 19 nt, Artificial Sequence
  Description of Artificial Sequence: Synthetic oligonucleotide
ccuucccucuuuagcugcc

SEQ ID NO: 4941 - RNA, 19 nt, Artificial Sequence
  Description of Artificial Sequence: Synthetic oligonucleotide
gcagcuaaagagggaaggg

SEQ ID NO: 4942 - RNA, 19 nt, Artificial Sequence
  Description of Artificial Sequence: Synthetic oligonucleotide
cccuucccucuuuagcugc

SEQ ID NO: 4943 - RNA, 19 nt, Artificial Sequence
  Description of Artificial Sequence: Synthetic oligonucleotide
gggcaugggauaagaccug

SEQ ID NO: 4944 - RNA, 19 nt, Artificial Sequence
  Description of Artificial Sequence: Synthetic oligonucleotide
caggucuuaucccaugccc

SEQ ID NO: 4945 - RNA, 19 nt, Artificial Sequence
  Description of Artificial Sequence: Synthetic oligonucleotide
ggcaugggauaagaccugc

SEQ ID NO: 4946 - RNA, 19 nt, Artificial Sequence
  Description of Artificial Sequence: Synthetic oligonucleotide
gcaggucuuaucccaugcc

SEQ ID NO: 4947 - RNA, 19 nt, Artificial Sequence
  Description of Artificial Sequence: Synthetic oligonucleotide
gcaugggauaagaccugcc

SEQ ID NO: 4948 - RNA, 19 nt, Artificial Sequence
  Description of Artificial Sequence: Synthetic oligonucleotide
ggcaggucuuaucccaugc

SEQ ID NO: 4949 - RNA, 19 nt, Artificial Sequence
  Description of Artificial Sequence: Synthetic oligonucleotide
caugggauaagaccugccc

SEQ ID NO: 4950 - RNA, 19 nt, Artificial Sequence
  Description of Artificial Sequence: Synthetic oligonucleotide
gggcaggucuuaucccaug

SEQ ID NO: 4951 - RNA, 19 nt, Artificial Sequence
  Description of Artificial Sequence: Synthetic oligonucleotide
augggauaagaccugcccu

SEQ ID NO: 4952 - RNA, 19 nt, Artificial Sequence
  Description of Artificial Sequence: Synthetic oligonucleotide
agggcaggucuuaucccau

SEQ ID NO: 4953 - RNA, 19 nt, Artificial Sequence
  Description of Artificial Sequence: Synthetic oligonucleotide
ugggauaagaccugcccuu

SEQ ID NO: 4954 - RNA, 19 nt, Artificial Sequence
  Description of Artificial Sequence: Synthetic oligonucleotide
aagggcaggucuuauccca

SEQ ID NO: 4955 - RNA, 19 nt, Artificial Sequence
  Description of Artificial Sequence: Synthetic oligonucleotide
gggauaagaccugcccuuc

SEQ ID NO: 4956 - RNA, 19 nt, Artificial Sequence
  Description of Artificial Sequence: Synthetic oligonucleotide
gaagggcaggucuuauccc

SEQ ID NO: 4957 - RNA, 19 nt, Artificial Sequence
  Description of Artificial Sequence: Synthetic oligonucleotide
ggauaagaccugcccuucu

SEQ ID NO: 4958 - RNA, 19 nt, Artificial Sequence
  Description of Artificial Sequence: Synthetic oligonucleotide
agaagggcaggucuuaucc

SEQ ID NO: 4959 - RNA, 19 nt, Artificial Sequence
  Description of Artificial Sequence: Synthetic oligonucleotide
agaccugcccuucuugcuu

SEQ ID NO: 4960 - RNA, 19 nt, Artificial Sequence
  Description of Artificial Sequence: Synthetic oligonucleotide
aagcaagaagggcaggucu

SEQ ID NO: 4961 - RNA, 19 nt, Artificial Sequence
  Description of Artificial Sequence: Synthetic oligonucleotide
gaccugcccuucuugcuuc

SEQ ID NO: 4962 - RNA, 19 nt, Artificial Sequence
  Description of Artificial Sequence: Synthetic oligonucleotide
gaagcaagaagggcagguc

SEQ ID NO: 4963 - RNA, 19 nt, Artificial Sequence
  Description of Artificial Sequence: Synthetic oligonucleotide
ccugcccuucuugcuucuu

SEQ ID NO: 4964 - RNA, 19 nt, Artificial Sequence
  Description of Artificial Sequence: Synthetic oligonucleotide
aagaagcaagaagggcagg

SEQ ID NO: 4965 - RNA, 19 nt, Artificial Sequence
  Description of Artificial Sequence: Synthetic oligonucleotide
cugcccuucuugcuucuug

SEQ ID NO: 4966 - RNA, 19 nt, Artificial Sequence
  Description of Artificial Sequence: Synthetic oligonucleotide
caagaagcaagaagggcag

SEQ ID NO: 4967 - RNA, 19 nt, Artificial Sequence
  Description of Artificial Sequence: Synthetic oligonucleotide
ugcccuucuugcuucuugc

SEQ ID NO: 4968 - RNA, 19 nt, Artificial Sequence
  Description of Artificial Sequence: Synthetic oligonucleotide
gcaagaagcaagaagggca

SEQ ID NO: 4969 - RNA, 19 nt, Artificial Sequence
  Description of Artificial Sequence: Synthetic oligonucleotide
ucuugcuucuugccauugg

SEQ ID NO: 4970 - RNA, 19 nt, Artificial Sequence
  Description of Artificial Sequence: Synthetic oligonucleotide
ccaauggcaagaagcaaga

SEQ ID NO: 4971 - RNA, 19 nt, Artificial Sequence
  Description of Artificial Sequence: Synthetic oligonucleotide
cuugcuucuugccauuggg

SEQ ID NO: 4972 - RNA, 19 nt, Artificial Sequence
  Description of Artificial Sequence: Synthetic oligonucleotide
cccaauggcaagaagcaag

SEQ ID NO: 4973 - RNA, 19 nt, Artificial Sequence
  Description of Artificial Sequence: Synthetic oligonucleotide
uugcuucuugccauugggc

SEQ ID NO: 4974 - RNA, 19 nt, Artificial Sequence
  Description of Artificial Sequence: Synthetic oligonucleotide
gcccaauggcaagaagcaa

SEQ ID NO: 4975 - RNA, 19 nt, Artificial Sequence
  Description of Artificial Sequence: Synthetic oligonucleotide
ccauugggcaggcauugga

SEQ ID NO: 4976 - RNA, 19 nt, Artificial Sequence
  Description of Artificial Sequence: Synthetic oligonucleotide
uccaaugccugcccaaugg

SEQ ID NO: 4977 - RNA, 19 nt, Artificial Sequence
  Description of Artificial Sequence: Synthetic oligonucleotide
cauugggcaggcauuggag

SEQ ID NO: 4978 - RNA, 19 nt, Artificial Sequence
  Description of Artificial Sequence: Synthetic oligonucleotide
cuccaaugccugcccaaug

SEQ ID NO: 4979 - RNA, 19 nt, Artificial Sequence
  Description of Artificial Sequence: Synthetic oligonucleotide
gacccuacugcugaaugga

SEQ ID NO: 4980 - RNA, 19 nt, Artificial Sequence
  Description of Artificial Sequence: Synthetic oligonucleotide
uccauucagcaguaggguc

SEQ ID NO: 4981 - RNA, 19 nt, Artificial Sequence
  Description of Artificial Sequence: Synthetic oligonucleotide
uacugcugaauggagugcu

SEQ ID NO: 4982 - RNA, 19 nt, Artificial Sequence
  Description of Artificial Sequence: Synthetic oligonucleotide
agcacuccauucagcagua

SEQ ID NO: 4983 - RNA, 19 nt, Artificial Sequence
  Description of Artificial Sequence: Synthetic oligonucleotide
acugcugaauggagugcua

SEQ ID NO: 4984 - RNA, 19 nt, Artificial Sequence
  Description of Artificial Sequence: Synthetic oligonucleotide
uagcacuccauucagcagu

SEQ ID NO: 4985 - RNA, 19 nt, Artificial Sequence
  Description of Artificial Sequence: Synthetic oligonucleotide
cugcugaauggagugcuaa

SEQ ID NO: 4986 - RNA, 19 nt, Artificial Sequence
  Description of Artificial Sequence: Synthetic oligonucleotide
uuagcacuccauucagcag

SEQ ID NO: 4987 - RNA, 19 nt, Artificial Sequence
  Description of Artificial Sequence: Synthetic oligonucleotide
ugcugaauggagugcuaac

SEQ ID NO: 4988 - RNA, 19 nt, Artificial Sequence
  Description of Artificial Sequence: Synthetic oligonucleotide
guuagcacuccauucagca

SEQ ID NO: 4989 - RNA, 19 nt, Artificial Sequence
  Description of Artificial Sequence: Synthetic oligonucleotide
gcugaauggagugcuaacc

SEQ ID NO: 4990 - RNA, 19 nt, Artificial Sequence
  Description of Artificial Sequence: Synthetic oligonucleotide
gguuagcacuccauucagc

SEQ ID NO: 4991 - RNA, 19 nt, Artificial Sequence
  Description of Artificial Sequence: Synthetic oligonucleotide
cugaauggagugcuaaccc

SEQ ID NO: 4992 - RNA, 19 nt, Artificial Sequence
  Description of Artificial Sequence: Synthetic oligonucleotide
ggguuagcacuccauucag

SEQ ID NO: 4993 - RNA, 19 nt, Artificial Sequence
  Description of Artificial Sequence: Synthetic oligonucleotide
uaacccuggugcuagagga

SEQ ID NO: 4994 - RNA, 19 nt, Artificial Sequence
  Description of Artificial Sequence: Synthetic oligonucleotide
uccucuagcaccaggguua

SEQ ID NO: 4995 - RNA, 19 nt, Artificial Sequence
  Description of Artificial Sequence: Synthetic oligonucleotide
aacccuggugcuagaggag

SEQ ID NO: 4996 - RNA, 19 nt, Artificial Sequence
  Description of Artificial Sequence: Synthetic oligonucleotide
cuccucuagcaccaggguu

SEQ ID NO: 4997 - RNA, 19 nt, Artificial Sequence
  Description of Artificial Sequence: Synthetic oligonucleotide
acccuggugcuagaggagg

SEQ ID NO: 4998 - RNA, 19 nt, Artificial Sequence
  Description of Artificial Sequence: Synthetic oligonucleotide
ccuccucuagcaccagggu

SEQ ID NO: 4999 - RNA, 19 nt, Artificial Sequence
  Description of Artificial Sequence: Synthetic oligonucleotide
cccuggugcuagaggagga

SEQ ID NO: 5000 - RNA, 19 nt, Artificial Sequence
  Description of Artificial Sequence: Synthetic oligonucleotide
uccuccucuagcaccaggg

SEQ ID NO: 5001 - RNA, 19 nt, Artificial Sequence
  Description of Artificial Sequence: Synthetic oligonucleotide
ccuggugcuagaggaggau

SEQ ID NO: 5002 - RNA, 19 nt, Artificial Sequence
  Description of Artificial Sequence: Synthetic oligonucleotide
auccuccucuagcaccagg

SEQ ID NO: 5003 - RNA, 19 nt, Artificial Sequence
  Description of Artificial Sequence: Synthetic oligonucleotide
cuggugcuagaggaggaug

SEQ ID NO: 5004 - RNA, 19 nt, Artificial Sequence
  Description of Artificial Sequence: Synthetic oligonucleotide
cauccuccucuagcaccag

SEQ ID NO: 5005 - RNA, 19 nt, Artificial Sequence
  Description of Artificial Sequence: Synthetic oligonucleotide
ggugcuagaggaggaugga

SEQ ID NO: 5006 - RNA, 19 nt, Artificial Sequence
  Description of Artificial Sequence: Synthetic oligonucleotide
uccauccuccucuagcacc

SEQ ID NO: 5007 - RNA, 19 nt, Artificial Sequence
  Description of Artificial Sequence: Synthetic oligonucleotide
gugcuagaggaggauggaa

SEQ ID NO: 5008 - RNA, 19 nt, Artificial Sequence
  Description of Artificial Sequence: Synthetic oligonucleotide
uuccauccuccucuagcac

SEQ ID NO: 5009 - RNA, 19 nt, Artificial Sequence
  Description of Artificial Sequence: Synthetic oligonucleotide
cugcaguggacagugagga

SEQ ID NO: 5010 - RNA, 19 nt, Artificial Sequence
  Description of Artificial Sequence: Synthetic oligonucleotide
uccucacuguccacugcag

SEQ ID NO: 5011 - RNA, 19 nt, Artificial Sequence
  Description of Artificial Sequence: Synthetic oligonucleotide
ugcaguggacagugaggac

SEQ ID NO: 5012 - RNA, 19 nt, Artificial Sequence
  Description of Artificial Sequence: Synthetic oligonucleotide
guccucacuguccacugca

SEQ ID NO: 5013 - RNA, 19 nt, Artificial Sequence
  Description of Artificial Sequence: Synthetic oligonucleotide
gcaguggacagugaggacu

SEQ ID NO: 5014 - RNA, 19 nt, Artificial Sequence
  Description of Artificial Sequence: Synthetic oligonucleotide
aguccucacuguccacugc

SEQ ID NO: 5015 - RNA, 19 nt, Artificial Sequence
  Description of Artificial Sequence: Synthetic oligonucleotide
caguggacagugaggacuu

SEQ ID NO: 5016 - RNA, 19 nt, Artificial Sequence
  Description of Artificial Sequence: Synthetic oligonucleotide
aaguccucacuguccacug

SEQ ID NO: 5017 - RNA, 19 nt, Artificial Sequence
  Description of Artificial Sequence: Synthetic oligonucleotide
aguggacagugaggacuuc

SEQ ID NO: 5018 - RNA, 19 nt, Artificial Sequence
  Description of Artificial Sequence: Synthetic oligonucleotide
gaaguccucacuguccacu

SEQ ID NO: 5019 - RNA, 19 nt, Artificial Sequence
  Description of Artificial Sequence: Synthetic oligonucleotide
guggacagugaggacuucu

SEQ ID NO: 5020 - RNA, 19 nt, Artificial Sequence
  Description of Artificial Sequence: Synthetic oligonucleotide
agaaguccucacuguccac

SEQ ID NO: 5021 - RNA, 19 nt, Artificial Sequence
  Description of Artificial Sequence: Synthetic oligonucleotide
uggacagugaggacuucuu

SEQ ID NO: 5022 - RNA, 19 nt, Artificial Sequence
  Description of Artificial Sequence: Synthetic oligonucleotide
aagaaguccucacugucca

SEQ ID NO: 5023 - RNA, 19 nt, Artificial Sequence
  Description of Artificial Sequence: Synthetic oligonucleotide
ggacagugaggacuucuuc

SEQ ID NO: 5024 - RNA, 19 nt, Artificial Sequence
  Description of Artificial Sequence: Synthetic oligonucleotide
gaagaaguccucacugucc

SEQ ID NO: 5025 - RNA, 19 nt, Artificial Sequence
  Description of Artificial Sequence: Synthetic oligonucleotide
agugaggacuucuuccagc

SEQ ID NO: 5026 - RNA, 19 nt, Artificial Sequence
  Description of Artificial Sequence: Synthetic oligonucleotide
gcuggaagaaguccucacu

SEQ ID NO: 5027 - RNA, 19 nt, Artificial Sequence
  Description of Artificial Sequence: Synthetic oligonucleotide
gugaggacuucuuccagcu

SEQ ID NO: 5028 - RNA, 19 nt, Artificial Sequence
  Description of Artificial Sequence: Synthetic oligonucleotide
agcuggaagaaguccucac

SEQ ID NO: 5029 - RNA, 19 nt, Artificial Sequence
  Description of Artificial Sequence: Synthetic oligonucleotide
ugaggacuucuuccagcug

SEQ ID NO: 5030 - RNA, 19 nt, Artificial Sequence
  Description of Artificial Sequence: Synthetic oligonucleotide
cagcuggaagaaguccuca

SEQ ID NO: 5031 - RNA, 19 nt, Artificial Sequence
  Description of Artificial Sequence: Synthetic oligonucleotide
gaggacuucuuccagcugc

SEQ ID NO: 5032 - RNA, 19 nt, Artificial Sequence
  Description of Artificial Sequence: Synthetic oligonucleotide
gcagcuggaagaaguccuc

SEQ ID NO: 5033 - RNA, 19 nt, Artificial Sequence
  Description of Artificial Sequence: Synthetic oligonucleotide
gugccugaugguguugcag

SEQ ID NO: 5034 - RNA, 19 nt, Artificial Sequence
  Description of Artificial Sequence: Synthetic oligonucleotide
cugcaacaccaucaggcac

SEQ ID NO: 5035 - RNA, 19 nt, Artificial Sequence
  Description of Artificial Sequence: Synthetic oligonucleotide
gaugguguugcagucuggu

SEQ ID NO: 5036 - RNA, 19 nt, Artificial Sequence
  Description of Artificial Sequence: Synthetic oligonucleotide
accagacugcaacaccauc

SEQ ID NO: 5037 - RNA, 19 nt, Artificial Sequence
  Description of Artificial Sequence: Synthetic oligonucleotide
ugguguugcagucugguca

SEQ ID NO: 5038 - RNA, 19 nt, Artificial Sequence
  Description of Artificial Sequence: Synthetic oligonucleotide
ugaccagacugcaacacca

SEQ ID NO: 5039 - RNA, 19 nt, Artificial Sequence
  Description of Artificial Sequence: Synthetic oligonucleotide
gguguugcagucuggucag

SEQ ID NO: 5040 - RNA, 19 nt, Artificial Sequence
  Description of Artificial Sequence: Synthetic oligonucleotide
cugaccagacugcaacacc

SEQ ID NO: 5041 - RNA, 19 nt, Artificial Sequence
  Description of Artificial Sequence: Synthetic oligonucleotide
guguugcagucuggucaga

SEQ ID NO: 5042 - RNA, 19 nt, Artificial Sequence
  Description of Artificial Sequence: Synthetic oligonucleotide
ucugaccagacugcaacac

SEQ ID NO: 5043 - RNA, 19 nt, Artificial Sequence
  Description of Artificial Sequence: Synthetic oligonucleotide
ugcagucuggucagagcug

SEQ ID NO: 5044 - RNA, 19 nt, Artificial Sequence
  Description of Artificial Sequence: Synthetic oligonucleotide
cagcucugaccagacugca

SEQ ID NO: 5045 - RNA, 19 nt, Artificial Sequence
  Description of Artificial Sequence: Synthetic oligonucleotide
gcagucuggucagagcugg

SEQ ID NO: 5046 - RNA, 19 nt, Artificial Sequence
  Description of Artificial Sequence: Synthetic oligonucleotide
ccagcucugaccagacugc

SEQ ID NO: 5047 - RNA, 19 nt, Artificial Sequence
  Description of Artificial Sequence: Synthetic oligonucleotide
cagucuggucagagcugga

SEQ ID NO: 5048 - RNA, 19 nt, Artificial Sequence
  Description of Artificial Sequence: Synthetic oligonucleotide
uccagcucugaccagacug

SEQ ID NO: 5049 - RNA, 19 nt, Artificial Sequence
  Description of Artificial Sequence: Synthetic oligonucleotide
agucuggucagagcuggag

SEQ ID NO: 5050 - RNA, 19 nt, Artificial Sequence
  Description of Artificial Sequence: Synthetic oligonucleotide
cuccagcucugaccagacu

SEQ ID NO: 5051 - RNA, 19 nt, Artificial Sequence
  Description of Artificial Sequence: Synthetic oligonucleotide
gucuggucagagcuggagc

SEQ ID NO: 5052 - RNA, 19 nt, Artificial Sequence
  Description of Artificial Sequence: Synthetic oligonucleotide
gcuccagcucugaccagac

SEQ ID NO: 5053 - RNA, 19 nt, Artificial Sequence
  Description of Artificial Sequence: Synthetic oligonucleotide
ucuggucagagcuggagcc

SEQ ID NO: 5054 - RNA, 19 nt, Artificial Sequence
  Description of Artificial Sequence: Synthetic oligonucleotide
ggcuccagcucugaccaga

SEQ ID NO: 5055 - RNA, 19 nt, Artificial Sequence
  Description of Artificial Sequence: Synthetic oligonucleotide
uggucagagcuggagcccu

SEQ ID NO: 5056 - RNA, 19 nt, Artificial Sequence
  Description of Artificial Sequence: Synthetic oligonucleotide
agggcuccagcucugacca

SEQ ID NO: 5057 - RNA, 19 nt, Artificial Sequence
  Description of Artificial Sequence: Synthetic oligonucleotide
ggucagagcuggagcccua

SEQ ID NO: 5058 - RNA, 19 nt, Artificial Sequence
  Description of Artificial Sequence: Synthetic oligonucleotide
uagggcuccagcucugacc

SEQ ID NO: 5059 - RNA, 19 nt, Artificial Sequence
  Description of Artificial Sequence: Synthetic oligonucleotide
gucagagcuggagcccuac

SEQ ID NO: 5060 - RNA, 19 nt, Artificial Sequence
  Description of Artificial Sequence: Synthetic oligonucleotide
guagggcuccagcucugac

SEQ ID NO: 5061 - RNA, 19 nt, Artificial Sequence
  Description of Artificial Sequence: Synthetic oligonucleotide
caaggguaagaggccuaua

SEQ ID NO: 5062 - RNA, 19 nt, Artificial Sequence
  Description of Artificial Sequence: Synthetic oligonucleotide
uauaggccucuuacccuug

SEQ ID NO: 5063 - RNA, 19 nt, Artificial Sequence
  Description of Artificial Sequence: Synthetic oligonucleotide
aaggguaagaggccuauac

SEQ ID NO: 5064 - RNA, 19 nt, Artificial Sequence
  Description of Artificial Sequence: Synthetic oligonucleotide
guauaggccucuuacccuu

SEQ ID NO: 5065 - RNA, 19 nt, Artificial Sequence
  Description of Artificial Sequence: Synthetic oligonucleotide
aggguaagaggccuauacu

SEQ ID NO: 5066 - RNA, 19 nt, Artificial Sequence
  Description of Artificial Sequence: Synthetic oligonucleotide
aguauaggccucuuacccu

SEQ ID NO: 5067 - RNA, 19 nt, Artificial Sequence
  Description of Artificial Sequence: Synthetic oligonucleotide
ggguaagaggccuauacug

SEQ ID NO: 5068 - RNA, 19 nt, Artificial Sequence
  Description of Artificial Sequence: Synthetic oligonucleotide
caguauaggccucuuaccc

SEQ ID NO: 5069 - RNA, 19 nt, Artificial Sequence
  Description of Artificial Sequence: Synthetic oligonucleotide
gguaagaggccuauacugg

SEQ ID NO: 5070 - RNA, 19 nt, Artificial Sequence
  Description of Artificial Sequence: Synthetic oligonucleotide
ccaguauaggccucuuacc

SEQ ID NO: 5071 - RNA, 19 nt, Artificial Sequence
  Description of Artificial Sequence: Synthetic oligonucleotide
guaagaggccuauacuggg

SEQ ID NO: 5072 - RNA, 19 nt, Artificial Sequence
  Description of Artificial Sequence: Synthetic oligonucleotide
cccaguauaggccucuuac

SEQ ID NO: 5073 - RNA, 19 nt, Artificial Sequence
  Description of Artificial Sequence: Synthetic oligonucleotide
gggcugcuuccaaugccug

SEQ ID NO: 5074 - RNA, 19 nt, Artificial Sequence
  Description of Artificial Sequence: Synthetic oligonucleotide
caggcauuggaagcagccc

SEQ ID NO: 5075 - RNA, 19 nt, Artificial Sequence
  Description of Artificial Sequence: Synthetic oligonucleotide
ggcugcuuccaaugccugu

SEQ ID NO: 5076 - RNA, 19 nt, Artificial Sequence
  Description of Artificial Sequence: Synthetic oligonucleotide
acaggcauuggaagcagcc

SEQ ID NO: 5077 - RNA, 19 nt, Artificial Sequence
  Description of Artificial Sequence: Synthetic oligonucleotide
gcugcuuccaaugccuguc

SEQ ID NO: 5078 - RNA, 19 nt, Artificial Sequence
  Description of Artificial Sequence: Synthetic oligonucleotide
gacaggcauuggaagcagc

SEQ ID NO: 5079 - RNA, 19 nt, Artificial Sequence
  Description of Artificial Sequence: Synthetic oligonucleotide
cugcuuccaaugccugucc

SEQ ID NO: 5080 - RNA, 19 nt, Artificial Sequence
  Description of Artificial Sequence: Synthetic oligonucleotide
ggacaggcauuggaagcag

SEQ ID NO: 5081 - RNA, 19 nt, Artificial Sequence
  Description of Artificial Sequence: Synthetic oligonucleotide
ugcuuccaaugccuguccu

SEQ ID NO: 5082 - RNA, 19 nt, Artificial Sequence
  Description of Artificial Sequence: Synthetic oligonucleotide
aggacaggcauuggaagca

SEQ ID NO: 5083 - RNA, 19 nt, Artificial Sequence
  Description of Artificial Sequence: Synthetic oligonucleotide
gcuuccaaugccuguccuu

SEQ ID NO: 5084 - RNA, 19 nt, Artificial Sequence
  Description of Artificial Sequence: Synthetic oligonucleotide
aaggacaggcauuggaagc

SEQ ID NO: 5085 - RNA, 19 nt, Artificial Sequence
  Description of Artificial Sequence: Synthetic oligonucleotide
cuuccaaugccuguccuuu

SEQ ID NO: 5086 - RNA, 19 nt, Artificial Sequence
  Description of Artificial Sequence: Synthetic oligonucleotide
aaaggacaggcauuggaag

SEQ ID NO: 5087 - RNA, 19 nt, Artificial Sequence
  Description of Artificial Sequence: Synthetic oligonucleotide
uuccaaugccuguccuuua

SEQ ID NO: 5088 - RNA, 19 nt, Artificial Sequence
  Description of Artificial Sequence: Synthetic oligonucleotide
uaaaggacaggcauuggaa

SEQ ID NO: 5089 - RNA, 19 nt, Artificial Sequence
  Description of Artificial Sequence: Synthetic oligonucleotide
uccaaugccuguccuuuag

SEQ ID NO: 5090 - RNA, 19 nt, Artificial Sequence
  Description of Artificial Sequence: Synthetic oligonucleotide
cuaaaggacaggcauugga

SEQ ID NO: 5091 - RNA, 19 nt, Artificial Sequence
  Description of Artificial Sequence: Synthetic oligonucleotide
caaugccuguccuuuagag

SEQ ID NO: 5092 - RNA, 19 nt, Artificial Sequence
  Description of Artificial Sequence: Synthetic oligonucleotide
cucuaaaggacaggcauug

SEQ ID NO: 5093 - RNA, 19 nt, Artificial Sequence
  Description of Artificial Sequence: Synthetic oligonucleotide
aaugccuguccuuuagagc

SEQ ID NO: 5094 - RNA, 19 nt, Artificial Sequence
  Description of Artificial Sequence: Synthetic oligonucleotide
gcucuaaaggacaggcauu

SEQ ID NO: 5095 - RNA, 19 nt, Artificial Sequence
  Description of Artificial Sequence: Synthetic oligonucleotide
augccuguccuuuagagcu

SEQ ID NO: 5096 - RNA, 19 nt, Artificial Sequence
  Description of Artificial Sequence: Synthetic oligonucleotide
agcucuaaaggacaggcau

SEQ ID NO: 5097 - RNA, 19 nt, Artificial Sequence
  Description of Artificial Sequence: Synthetic oligonucleotide
cuuccucucuagcuuaacc

SEQ ID NO: 5098 - RNA, 19 nt, Artificial Sequence
  Description of Artificial Sequence: Synthetic oligonucleotide
gguuaagcuagagaggaag

SEQ ID NO: 5099 - RNA, 19 nt, Artificial Sequence
  Description of Artificial Sequence: Synthetic oligonucleotide
uuccucucuagcuuaaccc

SEQ ID NO: 5100 - RNA, 19 nt, Artificial Sequence
  Description of Artificial Sequence: Synthetic oligonucleotide
ggguuaagcuagagaggaa

SEQ ID NO: 5101 - RNA, 19 nt, Artificial Sequence
  Description of Artificial Sequence: Synthetic oligonucleotide
ucucuagcuuaacccugau

SEQ ID NO: 5102 - RNA, 19 nt, Artificial Sequence
  Description of Artificial Sequence: Synthetic oligonucleotide
aucaggguuaagcuagaga

SEQ ID NO: 5103 - RNA, 19 nt, Artificial Sequence
  Description of Artificial Sequence: Synthetic oligonucleotide
uagcuuaacccugauccug

SEQ ID NO: 5104 - RNA, 19 nt, Artificial Sequence
  Description of Artificial Sequence: Synthetic oligonucleotide
caggaucaggguuaagcua

SEQ ID NO: 5105 - RNA, 19 nt, Artificial Sequence
  Description of Artificial Sequence: Synthetic oligonucleotide
gaccaggugcaggaggagu

SEQ ID NO: 5106 - RNA, 19 nt, Artificial Sequence
  Description of Artificial Sequence: Synthetic oligonucleotide
acuccuccugcaccugguc

SEQ ID NO: 5107 - RNA, 19 nt, Artificial Sequence
  Description of Artificial Sequence: Synthetic oligonucleotide
accaggugcaggaggaguu

SEQ ID NO: 5108 - RNA, 19 nt, Artificial Sequence
  Description of Artificial Sequence: Synthetic oligonucleotide
aacuccuccugcaccuggu

SEQ ID NO: 5109 - RNA, 19 nt, Artificial Sequence
  Description of Artificial Sequence: Synthetic oligonucleotide
ccaggugcaggaggaguug

SEQ ID NO: 5110 - RNA, 19 nt, Artificial Sequence
  Description of Artificial Sequence: Synthetic oligonucleotide
caacuccuccugcaccugg

SEQ ID NO: 5111 - RNA, 19 nt, Artificial Sequence
  Description of Artificial Sequence: Synthetic oligonucleotide
caggugcaggaggaguugu

SEQ ID NO: 5112 - RNA, 19 nt, Artificial Sequence
  Description of Artificial Sequence: Synthetic oligonucleotide
acaacuccuccugcaccug

SEQ ID NO: 5113 - RNA, 19 nt, Artificial Sequence
  Description of Artificial Sequence: Synthetic oligonucleotide
aggugcaggaggaguugug

SEQ ID NO: 5114 - RNA, 19 nt, Artificial Sequence
  Description of Artificial Sequence: Synthetic oligonucleotide
cacaacuccuccugcaccu

SEQ ID NO: 5115 - RNA, 19 nt, Artificial Sequence
  Description of Artificial Sequence: Synthetic oligonucleotide
ugcaggaggaguuguggaa

SEQ ID NO: 5116 - RNA, 19 nt, Artificial Sequence
  Description of Artificial Sequence: Synthetic oligonucleotide
uuccacaacuccuccugca

SEQ ID NO: 5117 - RNA, 19 nt, Artificial Sequence
  Description of Artificial Sequence: Synthetic oligonucleotide
gcaggaggaguuguggaau

SEQ ID NO: 5118 - RNA, 19 nt, Artificial Sequence
  Description of Artificial Sequence: Synthetic oligonucleotide
auuccacaacuccuccugc

SEQ ID NO: 5119 - RNA, 19 nt, Artificial Sequence
  Description of Artificial Sequence: Synthetic oligonucleotide
aggaggaguuguggaauug

SEQ ID NO: 5120 - RNA, 19 nt, Artificial Sequence
  Description of Artificial Sequence: Synthetic oligonucleotide
caauuccacaacuccuccu

SEQ ID NO: 5121 - RNA, 19 nt, Artificial Sequence
  Description of Artificial Sequence: Synthetic oligonucleotide
ggaggaguuguggaauugu

SEQ ID NO: 5122 - RNA, 19 nt, Artificial Sequence
  Description of Artificial Sequence: Synthetic oligonucleotide
acaauuccacaacuccucc

SEQ ID NO: 5123 - RNA, 19 nt, Artificial Sequence
  Description of Artificial Sequence: Synthetic oligonucleotide
gaggaguuguggaauuguc

SEQ ID NO: 5124 - RNA, 19 nt, Artificial Sequence
  Description of Artificial Sequence: Synthetic oligonucleotide
gacaauuccacaacuccuc

SEQ ID NO: 5125 - RNA, 19 nt, Artificial Sequence
  Description of Artificial Sequence: Synthetic oligonucleotide
aggaguuguggaauuguca

SEQ ID NO: 5126 - RNA, 19 nt, Artificial Sequence
  Description of Artificial Sequence: Synthetic oligonucleotide
ugacaauuccacaacuccu

SEQ ID NO: 5127 - RNA, 19 nt, Artificial Sequence
  Description of Artificial Sequence: Synthetic oligonucleotide
ggaguuguggaauugucaa

SEQ ID NO: 5128 - RNA, 19 nt, Artificial Sequence
  Description of Artificial Sequence: Synthetic oligonucleotide
uugacaauuccacaacucc

SEQ ID NO: 5129 - RNA, 19 nt, Artificial Sequence
  Description of Artificial Sequence: Synthetic oligonucleotide
gaguuguggaauugucaag

SEQ ID NO: 5130 - RNA, 19 nt, Artificial Sequence
  Description of Artificial Sequence: Synthetic oligonucleotide
cuugacaauuccacaacuc

SEQ ID NO: 5131 - RNA, 19 nt, Artificial Sequence
  Description of Artificial Sequence: Synthetic oligonucleotide
aguuguggaauugucaagg

SEQ ID NO: 5132 - RNA, 19 nt, Artificial Sequence
  Description of Artificial Sequence: Synthetic oligonucleotide
ccuugacaauuccacaacu

SEQ ID NO: 5133 - RNA, 19 nt, Artificial Sequence
  Description of Artificial Sequence: Synthetic oligonucleotide
guuguggaauugucaagga

SEQ ID NO: 5134 - RNA, 19 nt, Artificial Sequence
  Description of Artificial Sequence: Synthetic oligonucleotide
uccuugacaauuccacaac

SEQ ID NO: 5135 - RNA, 19 nt, Artificial Sequence
  Description of Artificial Sequence: Synthetic oligonucleotide
uggaauugucaaggauguc

SEQ ID NO: 5136 - RNA, 19 nt, Artificial Sequence
  Description of Artificial Sequence: Synthetic oligonucleotide
gacauccuugacaauucca

SEQ ID NO: 5137 - RNA, 19 nt, Artificial Sequence
  Description of Artificial Sequence: Synthetic oligonucleotide
ggaauugucaaggauguca

SEQ ID NO: 5138 - RNA, 19 nt, Artificial Sequence
  Description of Artificial Sequence: Synthetic oligonucleotide
ugacauccuugacaauucc

SEQ ID NO: 5139 - RNA, 19 nt, Artificial Sequence
  Description of Artificial Sequence: Synthetic oligonucleotide
aguccaagcgagggagggu

SEQ ID NO: 5140 - RNA, 19 nt, Artificial Sequence
  Description of Artificial Sequence: Synthetic oligonucleotide
acccucccucgcuuggacu

SEQ ID NO: 5141 - RNA, 19 nt, Artificial Sequence
  Description of Artificial Sequence: Synthetic oligonucleotide
caagcgagggagggucuga

SEQ ID NO: 5142 - RNA, 19 nt, Artificial Sequence
  Description of Artificial Sequence: Synthetic oligonucleotide
ucagacccucccucgcuug

SEQ ID NO: 5143 - RNA, 19 nt, Artificial Sequence
  Description of Artificial Sequence: Synthetic oligonucleotide
aagcgagggagggucugac

SEQ ID NO: 5144 - RNA, 19 nt, Artificial Sequence
  Description of Artificial Sequence: Synthetic oligonucleotide
gucagacccucccucgcuu

SEQ ID NO: 5145 - RNA, 19 nt, Artificial Sequence
  Description of Artificial Sequence: Synthetic oligonucleotide
cugacccagugcugaugga

SEQ ID NO: 5146 - RNA, 19 nt, Artificial Sequence
  Description of Artificial Sequence: Synthetic oligonucleotide
uccaucagcacugggucag

SEQ ID NO: 5147 - RNA, 19 nt, Artificial Sequence
  Description of Artificial Sequence: Synthetic oligonucleotide
agauuaguggugggugucu

SEQ ID NO: 5148 - RNA, 19 nt, Artificial Sequence
  Description of Artificial Sequence: Synthetic oligonucleotide
agacacccaccacuaaucu

SEQ ID NO: 5149 - RNA, 19 nt, Artificial Sequence
  Description of Artificial Sequence: Synthetic oligonucleotide
auuaguggugggugucugg

SEQ ID NO: 5150 - RNA, 19 nt, Artificial Sequence
  Description of Artificial Sequence: Synthetic oligonucleotide
ccagacacccaccacuaau

SEQ ID NO: 5151 - RNA, 19 nt, Artificial Sequence
  Description of Artificial Sequence: Synthetic oligonucleotide
uuaguggugggugucuggu

SEQ ID NO: 5152 - RNA, 19 nt, Artificial Sequence
  Description of Artificial Sequence: Synthetic oligonucleotide
accagacacccaccacuaa

SEQ ID NO: 5153 - RNA, 19 nt, Artificial Sequence
  Description of Artificial Sequence: Synthetic oligonucleotide
uaguggugggugucuggua

SEQ ID NO: 5154 - RNA, 19 nt, Artificial Sequence
  Description of Artificial Sequence: Synthetic oligonucleotide
uaccagacacccaccacua

SEQ ID NO: 5155 - RNA, 19 nt, Artificial Sequence
  Description of Artificial Sequence: Synthetic oligonucleotide
aguggugggugucugguau

SEQ ID NO: 5156 - RNA, 19 nt, Artificial Sequence
  Description of Artificial Sequence: Synthetic oligonucleotide
auaccagacacccaccacu

SEQ ID NO: 5157 - RNA, 19 nt, Artificial Sequence
  Description of Artificial Sequence: Synthetic oligonucleotide
guggugggugucugguaug

SEQ ID NO: 5158 - RNA, 19 nt, Artificial Sequence
  Description of Artificial Sequence: Synthetic oligonucleotide
cauaccagacacccaccac

SEQ ID NO: 5159 - RNA, 19 nt, Artificial Sequence
  Description of Artificial Sequence: Synthetic oligonucleotide
uggugggugucugguauga

SEQ ID NO: 5160 - RNA, 19 nt, Artificial Sequence
  Description of Artificial Sequence: Synthetic oligonucleotide
ucauaccagacacccacca

SEQ ID NO: 5161 - RNA, 19 nt, Artificial Sequence
  Description of Artificial Sequence: Synthetic oligonucleotide
ggugggugucugguaugag

SEQ ID NO: 5162 - RNA, 19 nt, Artificial Sequence
  Description of Artificial Sequence: Synthetic oligonucleotide
cucauaccagacacccacc

SEQ ID NO: 5163 - RNA, 19 nt, Artificial Sequence
  Description of Artificial Sequence: Synthetic oligonucleotide
gugggugucugguaugagg

SEQ ID NO: 5164 - RNA, 19 nt, Artificial Sequence
  Description of Artificial Sequence: Synthetic oligonucleotide
ccucauaccagacacccac

SEQ ID NO: 5165 - RNA, 19 nt, Artificial Sequence
  Description of Artificial Sequence: Synthetic oligonucleotide
ugggugucugguaugagga

SEQ ID NO: 5166 - RNA, 19 nt, Artificial Sequence
  Description of Artificial Sequence: Synthetic oligonucleotide
uccucauaccagacaccca

SEQ ID NO: 5167 - RNA, 19 nt, Artificial Sequence
  Description of Artificial Sequence: Synthetic oligonucleotide
gggugucugguaugaggau

SEQ ID NO: 5168 - RNA, 19 nt, Artificial Sequence
  Description of Artificial Sequence: Synthetic oligonucleotide
auccucauaccagacaccc

SEQ ID NO: 5169 - RNA, 19 nt, Artificial Sequence
  Description of Artificial Sequence: Synthetic oligonucleotide
ggugucugguaugaggauc

SEQ ID NO: 5170 - RNA, 19 nt, Artificial Sequence
  Description of Artificial Sequence: Synthetic oligonucleotide
gauccucauaccagacacc

SEQ ID NO: 5171 - RNA, 19 nt, Artificial Sequence
  Description of Artificial Sequence: Synthetic oligonucleotide
gugucugguaugaggaucu

SEQ ID NO: 5172 - RNA, 19 nt, Artificial Sequence
  Description of Artificial Sequence: Synthetic oligonucleotide
agauccucauaccagacac

SEQ ID NO: 5173 - RNA, 19 nt, Artificial Sequence
  Description of Artificial Sequence: Synthetic oligonucleotide
ugucugguaugaggaucua

SEQ ID NO: 5174 - RNA, 19 nt, Artificial Sequence
  Description of Artificial Sequence: Synthetic oligonucleotide
uagauccucauaccagaca

SEQ ID NO: 5175 - RNA, 19 nt, Artificial Sequence
  Description of Artificial Sequence: Synthetic oligonucleotide
caaggguguccuacagagu

SEQ ID NO: 5176 - RNA, 19 nt, Artificial Sequence
  Description of Artificial Sequence: Synthetic oligonucleotide
acucuguaggacacccuug

SEQ ID NO: 5177 - RNA, 19 nt, Artificial Sequence
  Description of Artificial Sequence: Synthetic oligonucleotide
aaggguguccuacagagug

SEQ ID NO: 5178 - RNA, 19 nt, Artificial Sequence
  Description of Artificial Sequence: Synthetic oligonucleotide
cacucuguaggacacccuu

SEQ ID NO: 5179 - RNA, 19 nt, Artificial Sequence
  Description of Artificial Sequence: Synthetic oligonucleotide
aggguguccuacagagugg

SEQ ID NO: 5180 - RNA, 19 nt, Artificial Sequence
  Description of Artificial Sequence: Synthetic oligonucleotide
ccacucuguaggacacccu

SEQ ID NO: 5181 - RNA, 19 nt, Artificial Sequence
  Description of Artificial Sequence: Synthetic oligonucleotide
ggguguccuacagagugga

SEQ ID NO: 5182 - RNA, 19 nt, Artificial Sequence
  Description of Artificial Sequence: Synthetic oligonucleotide
uccacucuguaggacaccc

SEQ ID NO: 5183 - RNA, 19 nt, Artificial Sequence
  Description of Artificial Sequence: Synthetic oligonucleotide
gguguccuacagaguggag

SEQ ID NO: 5184 - RNA, 19 nt, Artificial Sequence
  Description of Artificial Sequence: Synthetic oligonucleotide
cuccacucuguaggacacc

SEQ ID NO: 5185 - RNA, 19 nt, Artificial Sequence
  Description of Artificial Sequence: Synthetic oligonucleotide
uccuacagaguggagugcu

SEQ ID NO: 5186 - RNA, 19 nt, Artificial Sequence
  Description of Artificial Sequence: Synthetic oligonucleotide
agcacuccacucuguagga

SEQ ID NO: 5187 - RNA, 19 nt, Artificial Sequence
  Description of Artificial Sequence: Synthetic oligonucleotide
aguggagugcugucauaug

SEQ ID NO: 5188 - RNA, 19 nt, Artificial Sequence
  Description of Artificial Sequence: Synthetic oligonucleotide
cauaugacagcacuccacu

SEQ ID NO: 5189 - RNA, 19 nt, Artificial Sequence
  Description of Artificial Sequence: Synthetic oligonucleotide
guggagugcugucauaugg

SEQ ID NO: 5190 - RNA, 19 nt, Artificial Sequence
  Description of Artificial Sequence: Synthetic oligonucleotide
ccauaugacagcacuccac

SEQ ID NO: 5191 - RNA, 19 nt, Artificial Sequence
  Description of Artificial Sequence: Synthetic oligonucleotide
uggagugcugucauauggc

SEQ ID NO: 5192 - RNA, 19 nt, Artificial Sequence
  Description of Artificial Sequence: Synthetic oligonucleotide
gccauaugacagcacucca

SEQ ID NO: 5193 - RNA, 19 nt, Artificial Sequence
  Description of Artificial Sequence: Synthetic oligonucleotide
ggagugcugucauauggcc

SEQ ID NO: 5194 - RNA, 19 nt, Artificial Sequence
  Description of Artificial Sequence: Synthetic oligonucleotide
ggccauaugacagcacucc

SEQ ID NO: 5195 - RNA, 19 nt, Artificial Sequence
  Description of Artificial Sequence: Synthetic oligonucleotide
gagugcugucauauggccu

SEQ ID NO: 5196 - RNA, 19 nt, Artificial Sequence
  Description of Artificial Sequence: Synthetic oligonucleotide
aggccauaugacagcacuc

SEQ ID NO: 5197 - RNA, 19 nt, Artificial Sequence
  Description of Artificial Sequence: Synthetic oligonucleotide
agugcugucauauggccug

SEQ ID NO: 5198 - RNA, 19 nt, Artificial Sequence
  Description of Artificial Sequence: Synthetic oligonucleotide
caggccauaugacagcacu

SEQ ID NO: 5199 - RNA, 19 nt, Artificial Sequence
  Description of Artificial Sequence: Synthetic oligonucleotide
gugcugucauauggccugg

SEQ ID NO: 5200 - RNA, 19 nt, Artificial Sequence
  Description of Artificial Sequence: Synthetic oligonucleotide
ccaggccauaugacagcac

SEQ ID NO: 5201 - RNA, 19 nt, Artificial Sequence
  Description of Artificial Sequence: Synthetic oligonucleotide
ugcugucauauggccuggg

SEQ ID NO: 5202 - RNA, 19 nt, Artificial Sequence
  Description of Artificial Sequence: Synthetic oligonucleotide
cccaggccauaugacagca

SEQ ID NO: 5203 - RNA, 19 nt, Artificial Sequence
  Description of Artificial Sequence: Synthetic oligonucleotide
gcugucauauggccuggga

SEQ ID NO: 5204 - RNA, 19 nt, Artificial Sequence
  Description of Artificial Sequence: Synthetic oligonucleotide
ucccaggccauaugacagc

SEQ ID NO: 5205 - RNA, 19 nt, Artificial Sequence
  Description of Artificial Sequence: Synthetic oligonucleotide
cugucauauggccugggac

SEQ ID NO: 5206 - RNA, 19 nt, Artificial Sequence
  Description of Artificial Sequence: Synthetic oligonucleotide
gucccaggccauaugacag

SEQ ID NO: 5207 - RNA, 19 nt, Artificial Sequence
  Description of Artificial Sequence: Synthetic oligonucleotide
ugucauauggccugggacg

SEQ ID NO: 5208 - RNA, 19 nt, Artificial Sequence
  Description of Artificial Sequence: Synthetic oligonucleotide
cgucccaggccauaugaca

SEQ ID NO: 5209 - RNA, 19 nt, Artificial Sequence
  Description of Artificial Sequence: Synthetic oligonucleotide
gucauauggccugggacgg

SEQ ID NO: 5210 - RNA, 19 nt, Artificial Sequence
  Description of Artificial Sequence: Synthetic oligonucleotide
ccgucccaggccauaugac

SEQ ID NO: 5211 - RNA, 19 nt, Artificial Sequence
  Description of Artificial Sequence: Synthetic oligonucleotide
agaggcccaagcacagcaa

SEQ ID NO: 5212 - RNA, 19 nt, Artificial Sequence
  Description of Artificial Sequence: Synthetic oligonucleotide
uugcugugcuugggccucu

SEQ ID NO: 5213 - RNA, 19 nt, Artificial Sequence
  Description of Artificial Sequence: Synthetic oligonucleotide
gaggcccaagcacagcaag

SEQ ID NO: 5214 - RNA, 19 nt, Artificial Sequence
  Description of Artificial Sequence: Synthetic oligonucleotide
cuugcugugcuugggccuc

SEQ ID NO: 5215 - RNA, 19 nt, Artificial Sequence
  Description of Artificial Sequence: Synthetic oligonucleotide
aggcccaagcacagcaagg

SEQ ID NO: 5216 - RNA, 19 nt, Artificial Sequence
  Description of Artificial Sequence: Synthetic oligonucleotide
ccuugcugugcuugggccu

SEQ ID NO: 5217 - RNA, 19 nt, Artificial Sequence
  Description of Artificial Sequence: Synthetic oligonucleotide
ggcccaagcacagcaagga

SEQ ID NO: 5218 - RNA, 19 nt, Artificial Sequence
  Description of Artificial Sequence: Synthetic oligonucleotide
uccuugcugugcuugggcc

SEQ ID NO: 5219 - RNA, 19 nt, Artificial Sequence
  Description of Artificial Sequence: Synthetic oligonucleotide
ccaagcacagcaaggacau

SEQ ID NO: 5220 - RNA, 19 nt, Artificial Sequence
  Description of Artificial Sequence: Synthetic oligonucleotide
auguccuugcugugcuugg

SEQ ID NO: 5221 - RNA, 19 nt, Artificial Sequence
  Description of Artificial Sequence: Synthetic oligonucleotide
gcccgauucaccuuugacg

SEQ ID NO: 5222 - RNA, 19 nt, Artificial Sequence
  Description of Artificial Sequence: Synthetic oligonucleotide
cgucaaaggugaaucgggc

SEQ ID NO: 5223 - RNA, 19 nt, Artificial Sequence
  Description of Artificial Sequence: Synthetic oligonucleotide
gauucaccuuugacgugua

SEQ ID NO: 5224 - RNA, 19 nt, Artificial Sequence
  Description of Artificial Sequence: Synthetic oligonucleotide
uacacgucaaaggugaauc

SEQ ID NO: 5225 - RNA, 19 nt, Artificial Sequence
  Description of Artificial Sequence: Synthetic oligonucleotide
auucaccuuugacguguac

SEQ ID NO: 5226 - RNA, 19 nt, Artificial Sequence
  Description of Artificial Sequence: Synthetic oligonucleotide
guacacgucaaaggugaau

SEQ ID NO: 5227 - RNA, 19 nt, Artificial Sequence
  Description of Artificial Sequence: Synthetic oligonucleotide
uuggcagccugaaugucaa

SEQ ID NO: 5228 - RNA, 19 nt, Artificial Sequence
  Description of Artificial Sequence: Synthetic oligonucleotide
uugacauucaggcugccaa

SEQ ID NO: 5229 - RNA, 19 nt, Artificial Sequence
  Description of Artificial Sequence: Synthetic oligonucleotide
uggcagccugaaugucaaa

SEQ ID NO: 5230 - RNA, 19 nt, Artificial Sequence
  Description of Artificial Sequence: Synthetic oligonucleotide
uuugacauucaggcugcca

SEQ ID NO: 5231 - RNA, 19 nt, Artificial Sequence
  Description of Artificial Sequence: Synthetic oligonucleotide
ggcagccugaaugucaaag

SEQ ID NO: 5232 - RNA, 19 nt, Artificial Sequence
  Description of Artificial Sequence: Synthetic oligonucleotide
cuuugacauucaggcugcc

SEQ ID NO: 5233 - RNA, 19 nt, Artificial Sequence
  Description of Artificial Sequence: Synthetic oligonucleotide
gcagccugaaugucaaagc

SEQ ID NO: 5234 - RNA, 19 nt, Artificial Sequence
  Description of Artificial Sequence: Synthetic oligonucleotide
gcuuugacauucaggcugc

SEQ ID NO: 5235 - RNA, 19 nt, Artificial Sequence
  Description of Artificial Sequence: Synthetic oligonucleotide
cagccugaaugucaaagcc

SEQ ID NO: 5236 - RNA, 19 nt, Artificial Sequence
  Description of Artificial Sequence: Synthetic oligonucleotide
ggcuuugacauucaggcug

SEQ ID NO: 5237 - RNA, 19 nt, Artificial Sequence
  Description of Artificial Sequence: Synthetic oligonucleotide
agccugaaugucaaagcca

SEQ ID NO: 5238 - RNA, 19 nt, Artificial Sequence
  Description of Artificial Sequence: Synthetic oligonucleotide
uggcuuugacauucaggcu

SEQ ID NO: 5239 - RNA, 19 nt, Artificial Sequence
  Description of Artificial Sequence: Synthetic oligonucleotide
gccugaaugucaaagccac

SEQ ID NO: 5240 - RNA, 19 nt, Artificial Sequence
  Description of Artificial Sequence: Synthetic oligonucleotide
guggcuuugacauucaggc

SEQ ID NO: 5241 - RNA, 19 nt, Artificial Sequence
  Description of Artificial Sequence: Synthetic oligonucleotide
gucaaagccacauucuacg

SEQ ID NO: 5242 - RNA, 19 nt, Artificial Sequence
  Description of Artificial Sequence: Synthetic oligonucleotide
cguagaauguggcuuugac

SEQ ID NO: 5243 - RNA, 19 nt, Artificial Sequence
  Description of Artificial Sequence: Synthetic oligonucleotide
ucaaagccacauucuacgg

SEQ ID NO: 5244 - RNA, 19 nt, Artificial Sequence
  Description of Artificial Sequence: Synthetic oligonucleotide
ccguagaauguggcuuuga

SEQ ID NO: 5245 - RNA, 19 nt, Artificial Sequence
  Description of Artificial Sequence: Synthetic oligonucleotide
caaagccacauucuacggg

SEQ ID NO: 5246 - RNA, 19 nt, Artificial Sequence
  Description of Artificial Sequence: Synthetic oligonucleotide
cccguagaauguggcuuug

SEQ ID NO: 5247 - RNA, 19 nt, Artificial Sequence
  Description of Artificial Sequence: Synthetic oligonucleotide
aaagccacauucuacgggc

SEQ ID NO: 5248 - RNA, 19 nt, Artificial Sequence
  Description of Artificial Sequence: Synthetic oligonucleotide
gcccguagaauguggcuuu

SEQ ID NO: 5249 - RNA, 19 nt, Artificial Sequence
  Description of Artificial Sequence: Synthetic oligonucleotide
gccacauucuacgggcucu

SEQ ID NO: 5250 - RNA, 19 nt, Artificial Sequence
  Description of Artificial Sequence: Synthetic oligonucleotide
agagcccguagaauguggc

SEQ ID NO: 5251 - RNA, 19 nt, Artificial Sequence
  Description of Artificial Sequence: Synthetic oligonucleotide
ccacauucuacgggcucua

SEQ ID NO: 5252 - RNA, 19 nt, Artificial Sequence
  Description of Artificial Sequence: Synthetic oligonucleotide
uagagcccguagaaugugg

SEQ ID NO: 5253 - RNA, 19 nt, Artificial Sequence
  Description of Artificial Sequence: Synthetic oligonucleotide
cacauucuacgggcucuac

SEQ ID NO: 5254 - RNA, 19 nt, Artificial Sequence
  Description of Artificial Sequence: Synthetic oligonucleotide
guagagcccguagaaugug

SEQ ID NO: 5255 - RNA, 19 nt, Artificial Sequence
  Description of Artificial Sequence: Synthetic oligonucleotide
uucuacgggcucuacucua

SEQ ID NO: 5256 - RNA, 19 nt, Artificial Sequence
  Description of Artificial Sequence: Synthetic oligonucleotide
uagaguagagcccguagaa

SEQ ID NO: 5257 - RNA, 19 nt, Artificial Sequence
  Description of Artificial Sequence: Synthetic oligonucleotide
ucuacgggcucuacucuau

SEQ ID NO: 5258 - RNA, 19 nt, Artificial Sequence
  Description of Artificial Sequence: Synthetic oligonucleotide
auagaguagagcccguaga

SEQ ID NO: 5259 - RNA, 19 nt, Artificial Sequence
  Description of Artificial Sequence: Synthetic oligonucleotide
cuacgggcucuacucuaug

SEQ ID NO: 5260 - RNA, 19 nt, Artificial Sequence
  Description of Artificial Sequence: Synthetic oligonucleotide
cauagaguagagcccguag

SEQ ID NO: 5261 - RNA, 19 nt, Artificial Sequence
  Description of Artificial Sequence: Synthetic oligonucleotide
cucuaugaguugugacuuu

SEQ ID NO: 5262 - RNA, 19 nt, Artificial Sequence
  Description of Artificial Sequence: Synthetic oligonucleotide
aaagucacaacucauagag

SEQ ID NO: 5263 - RNA, 19 nt, Artificial Sequence
  Description of Artificial Sequence: Synthetic oligonucleotide
ucuaugaguugugacuuuc

SEQ ID NO: 5264 - RNA, 19 nt, Artificial Sequence
  Description of Artificial Sequence: Synthetic oligonucleotide
gaaagucacaacucauaga

SEQ ID NO: 5265 - RNA, 19 nt, Artificial Sequence
  Description of Artificial Sequence: Synthetic oligonucleotide
ugaguugugacuuucaagg

SEQ ID NO: 5266 - RNA, 19 nt, Artificial Sequence
  Description of Artificial Sequence: Synthetic oligonucleotide
ccuugaaagucacaacuca

SEQ ID NO: 5267 - RNA, 19 nt, Artificial Sequence
  Description of Artificial Sequence: Synthetic oligonucleotide
gaguugugacuuucaagga

SEQ ID NO: 5268 - RNA, 19 nt, Artificial Sequence
  Description of Artificial Sequence: Synthetic oligonucleotide
uccuugaaagucacaacuc

SEQ ID NO: 5269 - RNA, 19 nt, Artificial Sequence
  Description of Artificial Sequence: Synthetic oligonucleotide
aguugugacuuucaaggac

SEQ ID NO: 5270 - RNA, 19 nt, Artificial Sequence
  Description of Artificial Sequence: Synthetic oligonucleotide
guccuugaaagucacaacu

SEQ ID NO: 5271 - RNA, 19 nt, Artificial Sequence
  Description of Artificial Sequence: Synthetic oligonucleotide
guugugacuuucaaggacu

SEQ ID NO: 5272 - RNA, 19 nt, Artificial Sequence
  Description of Artificial Sequence: Synthetic oligonucleotide
aguccuugaaagucacaac

SEQ ID NO: 5273 - RNA, 19 nt, Artificial Sequence
  Description of Artificial Sequence: Synthetic oligonucleotide
gacuuucaaggacuuggcc

SEQ ID NO: 5274 - RNA, 19 nt, Artificial Sequence
  Description of Artificial Sequence: Synthetic oligonucleotide
ggccaaguccuugaaaguc

SEQ ID NO: 5275 - RNA, 19 nt, Artificial Sequence
  Description of Artificial Sequence: Synthetic oligonucleotide
uuucaaggacuuggcccaa

SEQ ID NO: 5276 - RNA, 19 nt, Artificial Sequence
  Description of Artificial Sequence: Synthetic oligonucleotide
uugggccaaguccuugaaa

SEQ ID NO: 5277 - RNA, 19 nt, Artificial Sequence
  Description of Artificial Sequence: Synthetic oligonucleotide
uucaaggacuuggcccaaa

SEQ ID NO: 5278 - RNA, 19 nt, Artificial Sequence
  Description of Artificial Sequence: Synthetic oligonucleotide
uuugggccaaguccuugaa

SEQ ID NO: 5279 - RNA, 19 nt, Artificial Sequence
  Description of Artificial Sequence: Synthetic oligonucleotide
cccuacaguuggauagucc

SEQ ID NO: 5280 - RNA, 19 nt, Artificial Sequence
  Description of Artificial Sequence: Synthetic oligonucleotide
ggacuauccaacuguaggg

SEQ ID NO: 5281 - RNA, 19 nt, Artificial Sequence
  Description of Artificial Sequence: Synthetic oligonucleotide
ccuacaguuggauaguccc

SEQ ID NO: 5282 - RNA, 19 nt, Artificial Sequence
  Description of Artificial Sequence: Synthetic oligonucleotide
gggacuauccaacuguagg

SEQ ID NO: 5283 - RNA, 19 nt, Artificial Sequence
  Description of Artificial Sequence: Synthetic oligonucleotide
auucguccucuugcaccca

SEQ ID NO: 5284 - RNA, 19 nt, Artificial Sequence
  Description of Artificial Sequence: Synthetic oligonucleotide
ugggugcaagaggacgaau

SEQ ID NO: 5285 - RNA, 19 nt, Artificial Sequence
  Description of Artificial Sequence: Synthetic oligonucleotide
uucguccucuugcacccac

SEQ ID NO: 5286 - RNA, 19 nt, Artificial Sequence
  Description of Artificial Sequence: Synthetic oligonucleotide
gugggugcaagaggacgaa

SEQ ID NO: 5287 - RNA, 19 nt, Artificial Sequence
  Description of Artificial Sequence: Synthetic oligonucleotide
uccucuugcacccaccuac

SEQ ID NO: 5288 - RNA, 19 nt, Artificial Sequence
  Description of Artificial Sequence: Synthetic oligonucleotide
guaggugggugcaagagga

SEQ ID NO: 5289 - RNA, 19 nt, Artificial Sequence
  Description of Artificial Sequence: Synthetic oligonucleotide
ccucuugcacccaccuacc

SEQ ID NO: 5290 - RNA, 19 nt, Artificial Sequence
  Description of Artificial Sequence: Synthetic oligonucleotide
gguaggugggugcaagagg

SEQ ID NO: 5291 - RNA, 19 nt, Artificial Sequence
  Description of Artificial Sequence: Synthetic oligonucleotide
cucuugcacccaccuaccc

SEQ ID NO: 5292 - RNA, 19 nt, Artificial Sequence
  Description of Artificial Sequence: Synthetic oligonucleotide
ggguaggugggugcaagag

SEQ ID NO: 5293 - RNA, 19 nt, Artificial Sequence
  Description of Artificial Sequence: Synthetic oligonucleotide
cuaguuagcucuugcuugu

SEQ ID NO: 5294 - RNA, 19 nt, Artificial Sequence
  Description of Artificial Sequence: Synthetic oligonucleotide
acaagcaagagcuaacuag

SEQ ID NO: 5295 - RNA, 19 nt, Artificial Sequence
  Description of Artificial Sequence: Synthetic oligonucleotide
uaguuagcucuugcuugug

SEQ ID NO: 5296 - RNA, 19 nt, Artificial Sequence
  Description of Artificial Sequence: Synthetic oligonucleotide
cacaagcaagagcuaacua

SEQ ID NO: 5297 - RNA, 19 nt, Artificial Sequence
  Description of Artificial Sequence: Synthetic oligonucleotide
aguuagcucuugcuugugg

SEQ ID NO: 5298 - RNA, 19 nt, Artificial Sequence
  Description of Artificial Sequence: Synthetic oligonucleotide
ccacaagcaagagcuaacu

SEQ ID NO: 5299 - RNA, 19 nt, Artificial Sequence
  Description of Artificial Sequence: Synthetic oligonucleotide
uuagcucuugcuuguggaa

SEQ ID NO: 5300 - RNA, 19 nt, Artificial Sequence
  Description of Artificial Sequence: Synthetic oligonucleotide
uuccacaagcaagagcuaa

SEQ ID NO: 5301 - RNA, 19 nt, Artificial Sequence
  Description of Artificial Sequence: Synthetic oligonucleotide
uccucaucucccagcuuga

SEQ ID NO: 5302 - RNA, 19 nt, Artificial Sequence
  Description of Artificial Sequence: Synthetic oligonucleotide
ucaagcugggagaugagga

SEQ ID NO: 5303 - RNA, 19 nt, Artificial Sequence
  Description of Artificial Sequence: Synthetic oligonucleotide
aucucccagcuugauggcu

SEQ ID NO: 5304 - RNA, 19 nt, Artificial Sequence
  Description of Artificial Sequence: Synthetic oligonucleotide
agccaucaagcugggagau

SEQ ID NO: 5305 - RNA, 19 nt, Artificial Sequence
  Description of Artificial Sequence: Synthetic oligonucleotide
ucucccagcuugauggcuu

SEQ ID NO: 5306 - RNA, 19 nt, Artificial Sequence
  Description of Artificial Sequence: Synthetic oligonucleotide
aagccaucaagcugggaga

SEQ ID NO: 5307 - RNA, 19 nt, Artificial Sequence
  Description of Artificial Sequence: Synthetic oligonucleotide
cucccagcuugauggcuuc

SEQ ID NO: 5308 - RNA, 19 nt, Artificial Sequence
  Description of Artificial Sequence: Synthetic oligonucleotide
gaagccaucaagcugggag

SEQ ID NO: 5309 - RNA, 19 nt, Artificial Sequence
  Description of Artificial Sequence: Synthetic oligonucleotide
ucccagcuugauggcuucc

SEQ ID NO: 5310 - RNA, 19 nt, Artificial Sequence
  Description of Artificial Sequence: Synthetic oligonucleotide
ggaagccaucaagcuggga

SEQ ID NO: 5311 - RNA, 19 nt, Artificial Sequence
  Description of Artificial Sequence: Synthetic oligonucleotide
cccagcuugauggcuuccu

SEQ ID NO: 5312 - RNA, 19 nt, Artificial Sequence
  Description of Artificial Sequence: Synthetic oligonucleotide
aggaagccaucaagcuggg

SEQ ID NO: 5313 - RNA, 19 nt, Artificial Sequence
  Description of Artificial Sequence: Synthetic oligonucleotide
ccagcuugauggcuuccuc

SEQ ID NO: 5314 - RNA, 19 nt, Artificial Sequence
  Description of Artificial Sequence: Synthetic oligonucleotide
gaggaagccaucaagcugg

SEQ ID NO: 5315 - RNA, 19 nt, Artificial Sequence
  Description of Artificial Sequence: Synthetic oligonucleotide
ugauggcuuccucccaagu

SEQ ID NO: 5316 - RNA, 19 nt, Artificial Sequence
  Description of Artificial Sequence: Synthetic oligonucleotide
acuugggaggaagccauca

SEQ ID NO: 5317 - RNA, 19 nt, Artificial Sequence
  Description of Artificial Sequence: Synthetic oligonucleotide
gauggcuuccucccaaguu

SEQ ID NO: 5318 - RNA, 19 nt, Artificial Sequence
  Description of Artificial Sequence: Synthetic oligonucleotide
aacuugggaggaagccauc

SEQ ID NO: 5319 - RNA, 19 nt, Artificial Sequence
  Description of Artificial Sequence: Synthetic oligonucleotide
ggcuuccucccaaguuuuc

SEQ ID NO: 5320 - RNA, 19 nt, Artificial Sequence
  Description of Artificial Sequence: Synthetic oligonucleotide
gaaaacuugggaggaagcc

SEQ ID NO: 5321 - RNA, 19 nt, Artificial Sequence
  Description of Artificial Sequence: Synthetic oligonucleotide
ccucccaaguuuuccaaau

SEQ ID NO: 5322 - RNA, 19 nt, Artificial Sequence
  Description of Artificial Sequence: Synthetic oligonucleotide
auuuggaaaacuugggagg

SEQ ID NO: 5323 - RNA, 19 nt, Artificial Sequence
  Description of Artificial Sequence: Synthetic oligonucleotide
cccaaguuuuccaaaucau

SEQ ID NO: 5324 - RNA, 19 nt, Artificial Sequence
  Description of Artificial Sequence: Synthetic oligonucleotide
augauuuggaaaacuuggg

SEQ ID NO: 5325 - RNA, 19 nt, Artificial Sequence
  Description of Artificial Sequence: Synthetic oligonucleotide
ccaaguuuuccaaaucauc

SEQ ID NO: 5326 - RNA, 19 nt, Artificial Sequence
  Description of Artificial Sequence: Synthetic oligonucleotide
gaugauuuggaaaacuugg

SEQ ID NO: 5327 - RNA, 19 nt, Artificial Sequence
  Description of Artificial Sequence: Synthetic oligonucleotide
caaguuuuccaaaucaucu

SEQ ID NO: 5328 - RNA, 19 nt, Artificial Sequence
  Description of Artificial Sequence: Synthetic oligonucleotide
agaugauuuggaaaacuug

SEQ ID NO: 5329 - RNA, 19 nt, Artificial Sequence
  Description of Artificial Sequence: Synthetic oligonucleotide
aaguuuuccaaaucaucug

SEQ ID NO: 5330 - RNA, 19 nt, Artificial Sequence
  Description of Artificial Sequence: Synthetic oligonucleotide
cagaugauuuggaaaacuu

SEQ ID NO: 5331 - RNA, 19 nt, Artificial Sequence
  Description of Artificial Sequence: Synthetic oligonucleotide
guuuuccaaaucaucugau

SEQ ID NO: 5332 - RNA, 19 nt, Artificial Sequence
  Description of Artificial Sequence: Synthetic oligonucleotide
aucagaugauuuggaaaac

SEQ ID NO: 5333 - RNA, 19 nt, Artificial Sequence
  Description of Artificial Sequence: Synthetic oligonucleotide
aucugauuuccucuugucu

SEQ ID NO: 5334 - RNA, 19 nt, Artificial Sequence
  Description of Artificial Sequence: Synthetic oligonucleotide
agacaagaggaaaucagau

SEQ ID NO: 5335 - RNA, 19 nt, Artificial Sequence
  Description of Artificial Sequence: Synthetic oligonucleotide
ucugauuuccucuugucuc

SEQ ID NO: 5336 - RNA, 19 nt, Artificial Sequence
  Description of Artificial Sequence: Synthetic oligonucleotide
gagacaagaggaaaucaga

SEQ ID NO: 5337 - RNA, 19 nt, Artificial Sequence
  Description of Artificial Sequence: Synthetic oligonucleotide
cugauuuccucuugucucu

SEQ ID NO: 5338 - RNA, 19 nt, Artificial Sequence
  Description of Artificial Sequence: Synthetic oligonucleotide
agagacaagaggaaaucag

SEQ ID NO: 5339 - RNA, 19 nt, Artificial Sequence
  Description of Artificial Sequence: Synthetic oligonucleotide
cucuugucucugccauuca

SEQ ID NO: 5340 - RNA, 19 nt, Artificial Sequence
  Description of Artificial Sequence: Synthetic oligonucleotide
ugaauggcagagacaagag

SEQ ID NO: 5341 - RNA, 19 nt, Artificial Sequence
  Description of Artificial Sequence: Synthetic oligonucleotide
guuggaccuccacacugcu

SEQ ID NO: 5342 - RNA, 19 nt, Artificial Sequence
  Description of Artificial Sequence: Synthetic oligonucleotide
agcaguguggagguccaac

SEQ ID NO: 5343 - RNA, 19 nt, Artificial Sequence
  Description of Artificial Sequence: Synthetic oligonucleotide
ccacacugcugcaaggccu

SEQ ID NO: 5344 - RNA, 19 nt, Artificial Sequence
  Description of Artificial Sequence: Synthetic oligonucleotide
aggccuugcagcagugugg

SEQ ID NO: 5345 - RNA, 19 nt, Artificial Sequence
  Description of Artificial Sequence: Synthetic oligonucleotide
cacacugcugcaaggccug

SEQ ID NO: 5346 - RNA, 19 nt, Artificial Sequence
  Description of Artificial Sequence: Synthetic oligonucleotide
caggccuugcagcagugug

SEQ ID NO: 5347 - RNA, 19 nt, Artificial Sequence
  Description of Artificial Sequence: Synthetic oligonucleotide
acacugcugcaaggccugg

SEQ ID NO: 5348 - RNA, 19 nt, Artificial Sequence
  Description of Artificial Sequence: Synthetic oligonucleotide
ccaggccuugcagcagugu

SEQ ID NO: 5349 - RNA, 19 nt, Artificial Sequence
  Description of Artificial Sequence: Synthetic oligonucleotide
ugcaaggccugggccauau

SEQ ID NO: 5350 - RNA, 19 nt, Artificial Sequence
  Description of Artificial Sequence: Synthetic oligonucleotide
auauggcccaggccuugca

SEQ ID NO: 5351 - RNA, 19 nt, Artificial Sequence
  Description of Artificial Sequence: Synthetic oligonucleotide
gcaaggccugggccauaug

SEQ ID NO: 5352 - RNA, 19 nt, Artificial Sequence
  Description of Artificial Sequence: Synthetic oligonucleotide
cauauggcccaggccuugc

SEQ ID NO: 5353 - RNA, 19 nt, Artificial Sequence
  Description of Artificial Sequence: Synthetic oligonucleotide
caaggccugggccauaugu

SEQ ID NO: 5354 - RNA, 19 nt, Artificial Sequence
  Description of Artificial Sequence: Synthetic oligonucleotide
acauauggcccaggccuug

SEQ ID NO: 5355 - RNA, 19 nt, Artificial Sequence
  Description of Artificial Sequence: Synthetic oligonucleotide
aaggccugggccauauguu

SEQ ID NO: 5356 - RNA, 19 nt, Artificial Sequence
  Description of Artificial Sequence: Synthetic oligonucleotide
aacauauggcccaggccuu

SEQ ID NO: 5357 - RNA, 19 nt, Artificial Sequence
  Description of Artificial Sequence: Synthetic oligonucleotide
aggccugggccauauguug

SEQ ID NO: 5358 - RNA, 19 nt, Artificial Sequence
  Description of Artificial Sequence: Synthetic oligonucleotide
caacauauggcccaggccu

SEQ ID NO: 5359 - RNA, 19 nt, Artificial Sequence
  Description of Artificial Sequence: Synthetic oligonucleotide
ggccugggccauauguugc

SEQ ID NO: 5360 - RNA, 19 nt, Artificial Sequence
  Description of Artificial Sequence: Synthetic oligonucleotide
gcaacauauggcccaggcc

SEQ ID NO: 5361 - RNA, 19 nt, Artificial Sequence
  Description of Artificial Sequence: Synthetic oligonucleotide
gccugggccauauguugcu

SEQ ID NO: 5362 - RNA, 19 nt, Artificial Sequence
  Description of Artificial Sequence: Synthetic oligonucleotide
agcaacauauggcccaggc

SEQ ID NO: 5363 - RNA, 19 nt, Artificial Sequence
  Description of Artificial Sequence: Synthetic oligonucleotide
ccugggccauauguugcug

SEQ ID NO: 5364 - RNA, 19 nt, Artificial Sequence
  Description of Artificial Sequence: Synthetic oligonucleotide
cagcaacauauggcccagg

SEQ ID NO: 5365 - RNA, 19 nt, Artificial Sequence
  Description of Artificial Sequence: Synthetic oligonucleotide
ggccauauguugcugggaa

SEQ ID NO: 5366 - RNA, 19 nt, Artificial Sequence
  Description of Artificial Sequence: Synthetic oligonucleotide
uucccagcaacauauggcc

SEQ ID NO: 5367 - RNA, 19 nt, Artificial Sequence
  Description of Artificial Sequence: Synthetic oligonucleotide
ccauauguugcugggaauu

SEQ ID NO: 5368 - RNA, 19 nt, Artificial Sequence
  Description of Artificial Sequence: Synthetic oligonucleotide
aauucccagcaacauaugg

SEQ ID NO: 5369 - RNA, 19 nt, Artificial Sequence
  Description of Artificial Sequence: Synthetic oligonucleotide
ggaauuuccuccacccuuc

SEQ ID NO: 5370 - RNA, 19 nt, Artificial Sequence
  Description of Artificial Sequence: Synthetic oligonucleotide
gaaggguggaggaaauucc

SEQ ID NO: 5371 - RNA, 19 nt, Artificial Sequence
  Description of Artificial Sequence: Synthetic oligonucleotide
gaauuuccuccacccuucg

SEQ ID NO: 5372 - RNA, 19 nt, Artificial Sequence
  Description of Artificial Sequence: Synthetic oligonucleotide
cgaaggguggaggaaauuc

SEQ ID NO: 5373 - RNA, 19 nt, Artificial Sequence
  Description of Artificial Sequence: Synthetic oligonucleotide
aauuuccuccacccuucgu

SEQ ID NO: 5374 - RNA, 19 nt, Artificial Sequence
  Description of Artificial Sequence: Synthetic oligonucleotide
acgaaggguggaggaaauu

SEQ ID NO: 5375 - RNA, 19 nt, Artificial Sequence
  Description of Artificial Sequence: Synthetic oligonucleotide
auuuccuccacccuucguc

SEQ ID NO: 5376 - RNA, 19 nt, Artificial Sequence
  Description of Artificial Sequence: Synthetic oligonucleotide
gacgaaggguggaggaaau

SEQ ID NO: 5377 - RNA, 19 nt, Artificial Sequence
  Description of Artificial Sequence: Synthetic oligonucleotide
uuuccuccacccuucguca

SEQ ID NO: 5378 - RNA, 19 nt, Artificial Sequence
  Description of Artificial Sequence: Synthetic oligonucleotide
ugacgaaggguggaggaaa

SEQ ID NO: 5379 - RNA, 19 nt, Artificial Sequence
  Description of Artificial Sequence: Synthetic oligonucleotide
uuccuccacccuucgucau

SEQ ID NO: 5380 - RNA, 19 nt, Artificial Sequence
  Description of Artificial Sequence: Synthetic oligonucleotide
augacgaaggguggaggaa

SEQ ID NO: 5381 - RNA, 19 nt, Artificial Sequence
  Description of Artificial Sequence: Synthetic oligonucleotide
uccuccacccuucgucaug

SEQ ID NO: 5382 - RNA, 19 nt, Artificial Sequence
  Description of Artificial Sequence: Synthetic oligonucleotide
caugacgaaggguggagga

SEQ ID NO: 5383 - RNA, 19 nt, Artificial Sequence
  Description of Artificial Sequence: Synthetic oligonucleotide
ccuccacccuucgucaugc

SEQ ID NO: 5384 - RNA, 19 nt, Artificial Sequence
  Description of Artificial Sequence: Synthetic oligonucleotide
gcaugacgaaggguggagg

SEQ ID NO: 5385 - RNA, 19 nt, Artificial Sequence
  Description of Artificial Sequence: Synthetic oligonucleotide
cuccacccuucgucaugca

SEQ ID NO: 5386 - RNA, 19 nt, Artificial Sequence
  Description of Artificial Sequence: Synthetic oligonucleotide
ugcaugacgaaggguggag

SEQ ID NO: 5387 - RNA, 19 nt, Artificial Sequence
  Description of Artificial Sequence: Synthetic oligonucleotide
ccuucgucaugcaguggag

SEQ ID NO: 5388 - RNA, 19 nt, Artificial Sequence
  Description of Artificial Sequence: Synthetic oligonucleotide
cuccacugcaugacgaagg

SEQ ID NO: 5389 - RNA, 19 nt, Artificial Sequence
  Description of Artificial Sequence: Synthetic oligonucleotide
cuucgucaugcaguggagg

SEQ ID NO: 5390 - RNA, 19 nt, Artificial Sequence
  Description of Artificial Sequence: Synthetic oligonucleotide
ccuccacugcaugacgaag

SEQ ID NO: 5391 - RNA, 19 nt, Artificial Sequence
  Description of Artificial Sequence: Synthetic oligonucleotide
uucgucaugcaguggaggg

SEQ ID NO: 5392 - RNA, 19 nt, Artificial Sequence
  Description of Artificial Sequence: Synthetic oligonucleotide
cccuccacugcaugacgaa

SEQ ID NO: 5393 - RNA, 19 nt, Artificial Sequence
  Description of Artificial Sequence: Synthetic oligonucleotide
cgccuccauuccuacuaag

SEQ ID NO: 5394 - RNA, 19 nt, Artificial Sequence
  Description of Artificial Sequence: Synthetic oligonucleotide
cuuaguaggaauggaggcg

SEQ ID NO: 5395 - RNA, 19 nt, Artificial Sequence
  Description of Artificial Sequence: Synthetic oligonucleotide
gccuccauuccuacuaagg

SEQ ID NO: 5396 - RNA, 19 nt, Artificial Sequence
  Description of Artificial Sequence: Synthetic oligonucleotide
ccuuaguaggaauggaggc

SEQ ID NO: 5397 - RNA, 19 nt, Artificial Sequence
  Description of Artificial Sequence: Synthetic oligonucleotide
ccuccauuccuacuaaggg

SEQ ID NO: 5398 - RNA, 19 nt, Artificial Sequence
  Description of Artificial Sequence: Synthetic oligonucleotide
cccuuaguaggaauggagg

SEQ ID NO: 5399 - RNA, 19 nt, Artificial Sequence
  Description of Artificial Sequence: Synthetic oligonucleotide
cagaaucauuccaaccgac

SEQ ID NO: 5400 - RNA, 19 nt, Artificial Sequence
  Description of Artificial Sequence: Synthetic oligonucleotide
gucgguuggaaugauucug

SEQ ID NO: 5401 - RNA, 19 nt, Artificial Sequence
  Description of Artificial Sequence: Synthetic oligonucleotide
agaaucauuccaaccgacc

SEQ ID NO: 5402 - RNA, 19 nt, Artificial Sequence
  Description of Artificial Sequence: Synthetic oligonucleotide
ggucgguuggaaugauucu

SEQ ID NO: 5403 - RNA, 19 nt, Artificial Sequence
  Description of Artificial Sequence: Synthetic oligonucleotide
gaaucauuccaaccgaccc

SEQ ID NO: 5404 - RNA, 19 nt, Artificial Sequence
  Description of Artificial Sequence: Synthetic oligonucleotide
gggucgguuggaaugauuc

SEQ ID NO: 5405 - RNA, 19 nt, Artificial Sequence
  Description of Artificial Sequence: Synthetic oligonucleotide
aaucauuccaaccgaccca

SEQ ID NO: 5406 - RNA, 19 nt, Artificial Sequence
  Description of Artificial Sequence: Synthetic oligonucleotide
ugggucgguuggaaugauu

SEQ ID NO: 5407 - RNA, 19 nt, Artificial Sequence
  Description of Artificial Sequence: Synthetic oligonucleotide
aucauuccaaccgacccac

SEQ ID NO: 5408 - RNA, 19 nt, Artificial Sequence
  Description of Artificial Sequence: Synthetic oligonucleotide
gugggucgguuggaaugau

SEQ ID NO: 5409 - RNA, 19 nt, Artificial Sequence
  Description of Artificial Sequence: Synthetic oligonucleotide
ucauuccaaccgacccacu

SEQ ID NO: 5410 - RNA, 19 nt, Artificial Sequence
  Description of Artificial Sequence: Synthetic oligonucleotide
agugggucgguuggaauga

SEQ ID NO: 5411 - RNA, 19 nt, Artificial Sequence
  Description of Artificial Sequence: Synthetic oligonucleotide
uccaaccgacccacugcaa

SEQ ID NO: 5412 - RNA, 19 nt, Artificial Sequence
  Description of Artificial Sequence: Synthetic oligonucleotide
uugcagugggucgguugga

SEQ ID NO: 5413 - RNA, 19 nt, Artificial Sequence
  Description of Artificial Sequence: Synthetic oligonucleotide
ccaaccgacccacugcaaa

SEQ ID NO: 5414 - RNA, 19 nt, Artificial Sequence
  Description of Artificial Sequence: Synthetic oligonucleotide
uuugcagugggucgguugg

SEQ ID NO: 5415 - RNA, 19 nt, Artificial Sequence
  Description of Artificial Sequence: Synthetic oligonucleotide
caaccgacccacugcaaag

SEQ ID NO: 5416 - RNA, 19 nt, Artificial Sequence
  Description of Artificial Sequence: Synthetic oligonucleotide
cuuugcagugggucgguug

SEQ ID NO: 5417 - RNA, 19 nt, Artificial Sequence
  Description of Artificial Sequence: Synthetic oligonucleotide
aaccgacccacugcaaaga

SEQ ID NO: 5418 - RNA, 19 nt, Artificial Sequence
  Description of Artificial Sequence: Synthetic oligonucleotide
ucuuugcagugggucgguu

SEQ ID NO: 5419 - RNA, 19 nt, Artificial Sequence
  Description of Artificial Sequence: Synthetic oligonucleotide
accgacccacugcaaagac

SEQ ID NO: 5420 - RNA, 19 nt, Artificial Sequence
  Description of Artificial Sequence: Synthetic oligonucleotide
gucuuugcagugggucggu

SEQ ID NO: 5421 - RNA, 19 nt, Artificial Sequence
  Description of Artificial Sequence: Synthetic oligonucleotide
ccgacccacugcaaagacu

SEQ ID NO: 5422 - RNA, 19 nt, Artificial Sequence
  Description of Artificial Sequence: Synthetic oligonucleotide
agucuuugcagugggucgg

SEQ ID NO: 5423 - RNA, 19 nt, Artificial Sequence
  Description of Artificial Sequence: Synthetic oligonucleotide
cgacccacugcaaagacua

SEQ ID NO: 5424 - RNA, 19 nt, Artificial Sequence
  Description of Artificial Sequence: Synthetic oligonucleotide
uagucuuugcagugggucg

SEQ ID NO: 5425 - RNA, 19 nt, Artificial Sequence
  Description of Artificial Sequence: Synthetic oligonucleotide
gacccacugcaaagacuau

SEQ ID NO: 5426 - RNA, 19 nt, Artificial Sequence
  Description of Artificial Sequence: Synthetic oligonucleotide
auagucuuugcaguggguc

SEQ ID NO: 5427 - RNA, 19 nt, Artificial Sequence
  Description of Artificial Sequence: Synthetic oligonucleotide
acccacugcaaagacuaug

SEQ ID NO: 5428 - RNA, 19 nt, Artificial Sequence
  Description of Artificial Sequence: Synthetic oligonucleotide
cauagucuuugcagugggu

SEQ ID NO: 5429 - RNA, 19 nt, Artificial Sequence
  Description of Artificial Sequence: Synthetic oligonucleotide
acugcaaagacuaugacag

SEQ ID NO: 5430 - RNA, 19 nt, Artificial Sequence
  Description of Artificial Sequence: Synthetic oligonucleotide
cugucauagucuuugcagu

SEQ ID NO: 5431 - RNA, 19 nt, Artificial Sequence
  Description of Artificial Sequence: Synthetic oligonucleotide
cugcaaagacuaugacagc

SEQ ID NO: 5432 - RNA, 19 nt, Artificial Sequence
  Description of Artificial Sequence: Synthetic oligonucleotide
gcugucauagucuuugcag

SEQ ID NO: 5433 - RNA, 19 nt, Artificial Sequence
  Description of Artificial Sequence: Synthetic oligonucleotide
ugcaaagacuaugacagca

SEQ ID NO: 5434 - RNA, 19 nt, Artificial Sequence
  Description of Artificial Sequence: Synthetic oligonucleotide
ugcugucauagucuuugca

SEQ ID NO: 5435 - RNA, 19 nt, Artificial Sequence
  Description of Artificial Sequence: Synthetic oligonucleotide
gcaaagacuaugacagcau

SEQ ID NO: 5436 - RNA, 19 nt, Artificial Sequence
  Description of Artificial Sequence: Synthetic oligonucleotide
augcugucauagucuuugc

SEQ ID NO: 5437 - RNA, 19 nt, Artificial Sequence
  Description of Artificial Sequence: Synthetic oligonucleotide
aaagacuaugacagcauca

SEQ ID NO: 5438 - RNA, 19 nt, Artificial Sequence
  Description of Artificial Sequence: Synthetic oligonucleotide
ugaugcugucauagucuuu

SEQ ID NO: 5439 - RNA, 19 nt, Artificial Sequence
  Description of Artificial Sequence: Synthetic oligonucleotide
aagacuaugacagcaucaa

SEQ ID NO: 5440 - RNA, 19 nt, Artificial Sequence
  Description of Artificial Sequence: Synthetic oligonucleotide
uugaugcugucauagucuu

SEQ ID NO: 5441 - RNA, 19 nt, Artificial Sequence
  Description of Artificial Sequence: Synthetic oligonucleotide
agacuaugacagcaucaaa

SEQ ID NO: 5442 - RNA, 19 nt, Artificial Sequence
  Description of Artificial Sequence: Synthetic oligonucleotide
uuugaugcugucauagucu

SEQ ID NO: 5443 - RNA, 19 nt, Artificial Sequence
  Description of Artificial Sequence: Synthetic oligonucleotide
gacuaugacagcaucaaau

SEQ ID NO: 5444 - RNA, 19 nt, Artificial Sequence
  Description of Artificial Sequence: Synthetic oligonucleotide
auuugaugcugucauaguc

SEQ ID NO: 5445 - RNA, 19 nt, Artificial Sequence
  Description of Artificial Sequence: Synthetic oligonucleotide
cuaugacagcaucaaauuu

SEQ ID NO: 5446 - RNA, 19 nt, Artificial Sequence
  Description of Artificial Sequence: Synthetic oligonucleotide
aaauuugaugcugucauag

SEQ ID NO: 5447 - RNA, 19 nt, Artificial Sequence
  Description of Artificial Sequence: Synthetic oligonucleotide
uaugacagcaucaaauuuc

SEQ ID NO: 5448 - RNA, 19 nt, Artificial Sequence
  Description of Artificial Sequence: Synthetic oligonucleotide
gaaauuugaugcugucaua

SEQ ID NO: 5449 - RNA, 19 nt, Artificial Sequence
  Description of Artificial Sequence: Synthetic oligonucleotide
gcaucaaauuucaggaccu

SEQ ID NO: 5450 - RNA, 19 nt, Artificial Sequence
  Description of Artificial Sequence: Synthetic oligonucleotide
agguccugaaauuugaugc

SEQ ID NO: 5451 - RNA, 19 nt, Artificial Sequence
  Description of Artificial Sequence: Synthetic oligonucleotide
aucaaauuucaggaccugc

SEQ ID NO: 5452 - RNA, 19 nt, Artificial Sequence
  Description of Artificial Sequence: Synthetic oligonucleotide
gcagguccugaaauuugau

SEQ ID NO: 5453 - RNA, 19 nt, Artificial Sequence
  Description of Artificial Sequence: Synthetic oligonucleotide
ucaaauuucaggaccugca

SEQ ID NO: 5454 - RNA, 19 nt, Artificial Sequence
  Description of Artificial Sequence: Synthetic oligonucleotide
ugcagguccugaaauuuga

SEQ ID NO: 5455 - RNA, 19 nt, Artificial Sequence
  Description of Artificial Sequence: Synthetic oligonucleotide
uucaggaccugcagacagu

SEQ ID NO: 5456 - RNA, 19 nt, Artificial Sequence
  Description of Artificial Sequence: Synthetic oligonucleotide
acugucugcagguccugaa

SEQ ID NO: 5457 - RNA, 19 nt, Artificial Sequence
  Description of Artificial Sequence: Synthetic oligonucleotide
ucaggaccugcagacagua

SEQ ID NO: 5458 - RNA, 19 nt, Artificial Sequence
  Description of Artificial Sequence: Synthetic oligonucleotide
uacugucugcagguccuga

SEQ ID NO: 5459 - RNA, 19 nt, Artificial Sequence
  Description of Artificial Sequence: Synthetic oligonucleotide
caggaccugcagacaguac

SEQ ID NO: 5460 - RNA, 19 nt, Artificial Sequence
  Description of Artificial Sequence: Synthetic oligonucleotide
guacugucugcagguccug

SEQ ID NO: 5461 - RNA, 19 nt, Artificial Sequence
  Description of Artificial Sequence: Synthetic oligonucleotide
aggaccugcagacaguaca

SEQ ID NO: 5462 - RNA, 19 nt, Artificial Sequence
  Description of Artificial Sequence: Synthetic oligonucleotide
uguacugucugcagguccu

SEQ ID NO: 5463 - RNA, 19 nt, Artificial Sequence
  Description of Artificial Sequence: Synthetic oligonucleotide
ggaccugcagacaguacag

SEQ ID NO: 5464 - RNA, 19 nt, Artificial Sequence
  Description of Artificial Sequence: Synthetic oligonucleotide
cuguacugucugcaggucc

SEQ ID NO: 5465 - RNA, 19 nt, Artificial Sequence
  Description of Artificial Sequence: Synthetic oligonucleotide
cugcagacaguacaggcua

SEQ ID NO: 5466 - RNA, 19 nt, Artificial Sequence
  Description of Artificial Sequence: Synthetic oligonucleotide
uagccuguacugucugcag

SEQ ID NO: 5467 - RNA, 19 nt, Artificial Sequence
  Description of Artificial Sequence: Synthetic oligonucleotide
gacaguacaggcuagauaa

SEQ ID NO: 5468 - RNA, 19 nt, Artificial Sequence
  Description of Artificial Sequence: Synthetic oligonucleotide
uuaucuagccuguacuguc

SEQ ID NO: 5469 - RNA, 19 nt, Artificial Sequence
  Description of Artificial Sequence: Synthetic oligonucleotide
acaguacaggcuagauaac

SEQ ID NO: 5470 - RNA, 19 nt, Artificial Sequence
  Description of Artificial Sequence: Synthetic oligonucleotide
guuaucuagccuguacugu

SEQ ID NO: 5471 - RNA, 19 nt, Artificial Sequence
  Description of Artificial Sequence: Synthetic oligonucleotide
caguacaggcuagauaacc

SEQ ID NO: 5472 - RNA, 19 nt, Artificial Sequence
  Description of Artificial Sequence: Synthetic oligonucleotide
gguuaucuagccuguacug

SEQ ID NO: 5473 - RNA, 19 nt, Artificial Sequence
  Description of Artificial Sequence: Synthetic oligonucleotide
aguacaggcuagauaaccc

SEQ ID NO: 5474 - RNA, 19 nt, Artificial Sequence
  Description of Artificial Sequence: Synthetic oligonucleotide
ggguuaucuagccuguacu

SEQ ID NO: 5475 - RNA, 19 nt, Artificial Sequence
  Description of Artificial Sequence: Synthetic oligonucleotide
guacaggcuagauaaccca

SEQ ID NO: 5476 - RNA, 19 nt, Artificial Sequence
  Description of Artificial Sequence: Synthetic oligonucleotide
uggguuaucuagccuguac

SEQ ID NO: 5477 - RNA, 19 nt, Artificial Sequence
  Description of Artificial Sequence: Synthetic oligonucleotide
uacaggcuagauaacccac

SEQ ID NO: 5478 - RNA, 19 nt, Artificial Sequence
  Description of Artificial Sequence: Synthetic oligonucleotide
guggguuaucuagccugua

SEQ ID NO: 5479 - RNA, 19 nt, Artificial Sequence
  Description of Artificial Sequence: Synthetic oligonucleotide
gcuagauaacccacccaau

SEQ ID NO: 5480 - RNA, 19 nt, Artificial Sequence
  Description of Artificial Sequence: Synthetic oligonucleotide
auuggguggguuaucuagc

SEQ ID NO: 5481 - RNA, 19 nt, Artificial Sequence
  Description of Artificial Sequence: Synthetic oligonucleotide
cuagauaacccacccaauu

SEQ ID NO: 5482 - RNA, 19 nt, Artificial Sequence
  Description of Artificial Sequence: Synthetic oligonucleotide
aauuggguggguuaucuag

SEQ ID NO: 5483 - RNA, 19 nt, Artificial Sequence
  Description of Artificial Sequence: Synthetic oligonucleotide
agauaacccacccaauuuc

SEQ ID NO: 5484 - RNA, 19 nt, Artificial Sequence
  Description of Artificial Sequence: Synthetic oligonucleotide
gaaauuggguggguuaucu

SEQ ID NO: 5485 - RNA, 19 nt, Artificial Sequence
  Description of Artificial Sequence: Synthetic oligonucleotide
gauaacccacccaauuucc

SEQ ID NO: 5486 - RNA, 19 nt, Artificial Sequence
  Description of Artificial Sequence: Synthetic oligonucleotide
ggaaauuggguggguuauc

SEQ ID NO: 5487 - RNA, 19 nt, Artificial Sequence
  Description of Artificial Sequence: Synthetic oligonucleotide
aaccuuucagcauaacgcc

SEQ ID NO: 5488 - RNA, 19 nt, Artificial Sequence
  Description of Artificial Sequence: Synthetic oligonucleotide
ggcguuaugcugaaagguu

SEQ ID NO: 5489 - RNA, 19 nt, Artificial Sequence
  Description of Artificial Sequence: Synthetic oligonucleotide
accuuucagcauaacgccu

SEQ ID NO: 5490 - RNA, 19 nt, Artificial Sequence
  Description of Artificial Sequence: Synthetic oligonucleotide
aggcguuaugcugaaaggu

SEQ ID NO: 5491 - RNA, 19 nt, Artificial Sequence
  Description of Artificial Sequence: Synthetic oligonucleotide
ccuuucagcauaacgccuc

SEQ ID NO: 5492 - RNA, 19 nt, Artificial Sequence
  Description of Artificial Sequence: Synthetic oligonucleotide
gaggcguuaugcugaaagg

SEQ ID NO: 5493 - RNA, 19 nt, Artificial Sequence
  Description of Artificial Sequence: Synthetic oligonucleotide
cuuucagcauaacgccuca

SEQ ID NO: 5494 - RNA, 19 nt, Artificial Sequence
  Description of Artificial Sequence: Synthetic oligonucleotide
ugaggcguuaugcugaaag

SEQ ID NO: 5495 - RNA, 19 nt, Artificial Sequence
  Description of Artificial Sequence: Synthetic oligonucleotide
uuucagcauaacgccucac

SEQ ID NO: 5496 - RNA, 19 nt, Artificial Sequence
  Description of Artificial Sequence: Synthetic oligonucleotide
gugaggcguuaugcugaaa

SEQ ID NO: 5497 - RNA, 19 nt, Artificial Sequence
  Description of Artificial Sequence: Synthetic oligonucleotide
uucagcauaacgccucaca

SEQ ID NO: 5498 - RNA, 19 nt, Artificial Sequence
  Description of Artificial Sequence: Synthetic oligonucleotide
ugugaggcguuaugcugaa

SEQ ID NO: 5499 - RNA, 19 nt, Artificial Sequence
  Description of Artificial Sequence: Synthetic oligonucleotide
ucagcauaacgccucacau

SEQ ID NO: 5500 - RNA, 19 nt, Artificial Sequence
  Description of Artificial Sequence: Synthetic oligonucleotide
augugaggcguuaugcuga

SEQ ID NO: 5501 - RNA, 19 nt, Artificial Sequence
  Description of Artificial Sequence: Synthetic oligonucleotide
cagcauaacgccucacauc

SEQ ID NO: 5502 - RNA, 19 nt, Artificial Sequence
  Description of Artificial Sequence: Synthetic oligonucleotide
gaugugaggcguuaugcug

SEQ ID NO: 5503 - RNA, 19 nt, Artificial Sequence
  Description of Artificial Sequence: Synthetic oligonucleotide
agcauaacgccucacaucc

SEQ ID NO: 5504 - RNA, 19 nt, Artificial Sequence
  Description of Artificial Sequence: Synthetic oligonucleotide
ggaugugaggcguuaugcu

SEQ ID NO: 5505 - RNA, 19 nt, Artificial Sequence
  Description of Artificial Sequence: Synthetic oligonucleotide
gcauaacgccucacauccc

SEQ ID NO: 5506 - RNA, 19 nt, Artificial Sequence
  Description of Artificial Sequence: Synthetic oligonucleotide
gggaugugaggcguuaugc

SEQ ID NO: 5507 - RNA, 19 nt, Artificial Sequence
  Description of Artificial Sequence: Synthetic oligonucleotide
aacgccucacaucccaagu

SEQ ID NO: 5508 - RNA, 19 nt, Artificial Sequence
  Description of Artificial Sequence: Synthetic oligonucleotide
acuugggaugugaggcguu

SEQ ID NO: 5509 - RNA, 19 nt, Artificial Sequence
  Description of Artificial Sequence: Synthetic oligonucleotide
acgccucacaucccaaguc

SEQ ID NO: 5510 - RNA, 19 nt, Artificial Sequence
  Description of Artificial Sequence: Synthetic oligonucleotide
gacuugggaugugaggcgu

SEQ ID NO: 5511 - RNA, 19 nt, Artificial Sequence
  Description of Artificial Sequence: Synthetic oligonucleotide
cgccucacaucccaagucu

SEQ ID NO: 5512 - RNA, 19 nt, Artificial Sequence
  Description of Artificial Sequence: Synthetic oligonucleotide
agacuugggaugugaggcg

SEQ ID NO: 5513 - RNA, 19 nt, Artificial Sequence
  Description of Artificial Sequence: Synthetic oligonucleotide
ucacaucccaagucuauac

SEQ ID NO: 5514 - RNA, 19 nt, Artificial Sequence
  Description of Artificial Sequence: Synthetic oligonucleotide
guauagacuugggauguga

SEQ ID NO: 5515 - RNA, 19 nt, Artificial Sequence
  Description of Artificial Sequence: Synthetic oligonucleotide
cacaucccaagucuauacc

SEQ ID NO: 5516 - RNA, 19 nt, Artificial Sequence
  Description of Artificial Sequence: Synthetic oligonucleotide
gguauagacuugggaugug

SEQ ID NO: 5517 - RNA, 19 nt, Artificial Sequence
  Description of Artificial Sequence: Synthetic oligonucleotide
acaucccaagucuauaccc

SEQ ID NO: 5518 - RNA, 19 nt, Artificial Sequence
  Description of Artificial Sequence: Synthetic oligonucleotide
ggguauagacuugggaugu

SEQ ID NO: 5519 - RNA, 19 nt, Artificial Sequence
  Description of Artificial Sequence: Synthetic oligonucleotide
caucccaagucuauacccu

SEQ ID NO: 5520 - RNA, 19 nt, Artificial Sequence
  Description of Artificial Sequence: Synthetic oligonucleotide
aggguauagacuugggaug

SEQ ID NO: 5521 - RNA, 19 nt, Artificial Sequence
  Description of Artificial Sequence: Synthetic oligonucleotide
aaugcuguucuuuccuagc

SEQ ID NO: 5522 - RNA, 19 nt, Artificial Sequence
  Description of Artificial Sequence: Synthetic oligonucleotide
gcuaggaaagaacagcauu

SEQ ID NO: 5523 - RNA, 19 nt, Artificial Sequence
  Description of Artificial Sequence: Synthetic oligonucleotide
augcuguucuuuccuagcc

SEQ ID NO: 5524 - RNA, 19 nt, Artificial Sequence
  Description of Artificial Sequence: Synthetic oligonucleotide
ggcuaggaaagaacagcau

SEQ ID NO: 5525 - RNA, 19 nt, Artificial Sequence
  Description of Artificial Sequence: Synthetic oligonucleotide
cuguucuuuccuagccacc

SEQ ID NO: 5526 - RNA, 19 nt, Artificial Sequence
  Description of Artificial Sequence: Synthetic oligonucleotide
gguggcuaggaaagaacag

SEQ ID NO: 5527 - RNA, 19 nt, Artificial Sequence
  Description of Artificial Sequence: Synthetic oligonucleotide
uguucuuuccuagccaccu

SEQ ID NO: 5528 - RNA, 19 nt, Artificial Sequence
  Description of Artificial Sequence: Synthetic oligonucleotide
agguggcuaggaaagaaca

SEQ ID NO: 5529 - RNA, 19 nt, Artificial Sequence
  Description of Artificial Sequence: Synthetic oligonucleotide
gccaagaucaagauguccc

SEQ ID NO: 5530 - RNA, 19 nt, Artificial Sequence
  Description of Artificial Sequence: Synthetic oligonucleotide
gggacaucuugaucuuggc

SEQ ID NO: 5531 - RNA, 19 nt, Artificial Sequence
  Description of Artificial Sequence: Synthetic oligonucleotide
ucuugaucccagccugacu

SEQ ID NO: 5532 - RNA, 19 nt, Artificial Sequence
  Description of Artificial Sequence: Synthetic oligonucleotide
agucaggcugggaucaaga

SEQ ID NO: 5533 - RNA, 19 nt, Artificial Sequence
  Description of Artificial Sequence: Synthetic oligonucleotide
cuugaucccagccugacug

SEQ ID NO: 5534 - RNA, 19 nt, Artificial Sequence
  Description of Artificial Sequence: Synthetic oligonucleotide
cagucaggcugggaucaag

SEQ ID NO: 5535 - RNA, 19 nt, Artificial Sequence
  Description of Artificial Sequence: Synthetic oligonucleotide
uugaucccagccugacugc

SEQ ID NO: 5536 - RNA, 19 nt, Artificial Sequence
  Description of Artificial Sequence: Synthetic oligonucleotide
gcagucaggcugggaucaa

SEQ ID NO: 5537 - RNA, 19 nt, Artificial Sequence
  Description of Artificial Sequence: Synthetic oligonucleotide
ugaucccagccugacugcu

SEQ ID NO: 5538 - RNA, 19 nt, Artificial Sequence
  Description of Artificial Sequence: Synthetic oligonucleotide
agcagucaggcugggauca

SEQ ID NO: 5539 - RNA, 19 nt, Artificial Sequence
  Description of Artificial Sequence: Synthetic oligonucleotide
cugacugcugcuacaucua

SEQ ID NO: 5540 - RNA, 19 nt, Artificial Sequence
  Description of Artificial Sequence: Synthetic oligonucleotide
uagauguagcagcagucag

SEQ ID NO: 5541 - RNA, 19 nt, Artificial Sequence
  Description of Artificial Sequence: Synthetic oligonucleotide
gacugcugcuacaucuaau

SEQ ID NO: 5542 - RNA, 19 nt, Artificial Sequence
  Description of Artificial Sequence: Synthetic oligonucleotide
auuagauguagcagcaguc

SEQ ID NO: 5543 - RNA, 19 nt, Artificial Sequence
  Description of Artificial Sequence: Synthetic oligonucleotide
acugcugcuacaucuaauc

SEQ ID NO: 5544 - RNA, 19 nt, Artificial Sequence
  Description of Artificial Sequence: Synthetic oligonucleotide
gauuagauguagcagcagu

SEQ ID NO: 5545 - RNA, 19 nt, Artificial Sequence
  Description of Artificial Sequence: Synthetic oligonucleotide
cugcugcuacaucuaaucc

SEQ ID NO: 5546 - RNA, 19 nt, Artificial Sequence
  Description of Artificial Sequence: Synthetic oligonucleotide
ggauuagauguagcagcag

SEQ ID NO: 5547 - RNA, 19 nt, Artificial Sequence
  Description of Artificial Sequence: Synthetic oligonucleotide
ugcugcuacaucuaauccc

SEQ ID NO: 5548 - RNA, 19 nt, Artificial Sequence
  Description of Artificial Sequence: Synthetic oligonucleotide
gggauuagauguagcagca

SEQ ID NO: 5549 - RNA, 19 nt, Artificial Sequence
  Description of Artificial Sequence: Synthetic oligonucleotide
ccuaccaaugccuccuguc

SEQ ID NO: 5550 - RNA, 19 nt, Artificial Sequence
  Description of Artificial Sequence: Synthetic oligonucleotide
gacaggaggcauugguagg

SEQ ID NO: 5551 - RNA, 19 nt, Artificial Sequence
  Description of Artificial Sequence: Synthetic oligonucleotide
cuaccaaugccuccugucc

SEQ ID NO: 5552 - RNA, 19 nt, Artificial Sequence
  Description of Artificial Sequence: Synthetic oligonucleotide
ggacaggaggcauugguag

SEQ ID NO: 5553 - RNA, 19 nt, Artificial Sequence
  Description of Artificial Sequence: Synthetic oligonucleotide
ccaaugccuccugucccua

SEQ ID NO: 5554 - RNA, 19 nt, Artificial Sequence
  Description of Artificial Sequence: Synthetic oligonucleotide
uagggacaggaggcauugg

SEQ ID NO: 5555 - RNA, 19 nt, Artificial Sequence
  Description of Artificial Sequence: Synthetic oligonucleotide
caaugccuccugucccuaa

SEQ ID NO: 5556 - RNA, 19 nt, Artificial Sequence
  Description of Artificial Sequence: Synthetic oligonucleotide
uuagggacaggaggcauug

SEQ ID NO: 5557 - RNA, 19 nt, Artificial Sequence
  Description of Artificial Sequence: Synthetic oligonucleotide
aaugccuccugucccuaaa

SEQ ID NO: 5558 - RNA, 19 nt, Artificial Sequence
  Description of Artificial Sequence: Synthetic oligonucleotide
uuuagggacaggaggcauu

SEQ ID NO: 5559 - RNA, 19 nt, Artificial Sequence
  Description of Artificial Sequence: Synthetic oligonucleotide
cccagcauacugaugacag

SEQ ID NO: 5560 - RNA, 19 nt, Artificial Sequence
  Description of Artificial Sequence: Synthetic oligonucleotide
cugucaucaguaugcuggg

SEQ ID NO: 5561 - RNA, 19 nt, Artificial Sequence
  Description of Artificial Sequence: Synthetic oligonucleotide
ccagcauacugaugacagc

SEQ ID NO: 5562 - RNA, 19 nt, Artificial Sequence
  Description of Artificial Sequence: Synthetic oligonucleotide
gcugucaucaguaugcugg

SEQ ID NO: 5563 - RNA, 19 nt, Artificial Sequence
  Description of Artificial Sequence: Synthetic oligonucleotide
cauacugaugacagcccuc

SEQ ID NO: 5564 - RNA, 19 nt, Artificial Sequence
  Description of Artificial Sequence: Synthetic oligonucleotide
gagggcugucaucaguaug

SEQ ID NO: 5565 - RNA, 19 nt, Artificial Sequence
  Description of Artificial Sequence: Synthetic oligonucleotide
auacugaugacagcccucu

SEQ ID NO: 5566 - RNA, 19 nt, Artificial Sequence
  Description of Artificial Sequence: Synthetic oligonucleotide
agagggcugucaucaguau

SEQ ID NO: 5567 - RNA, 19 nt, Artificial Sequence
  Description of Artificial Sequence: Synthetic oligonucleotide
uacugaugacagcccucuc

SEQ ID NO: 5568 - RNA, 19 nt, Artificial Sequence
  Description of Artificial Sequence: Synthetic oligonucleotide
gagagggcugucaucagua

SEQ ID NO: 5569 - RNA, 19 nt, Artificial Sequence
  Description of Artificial Sequence: Synthetic oligonucleotide
acugaugacagcccucucu

SEQ ID NO: 5570 - RNA, 19 nt, Artificial Sequence
  Description of Artificial Sequence: Synthetic oligonucleotide
agagagggcugucaucagu

SEQ ID NO: 5571 - RNA, 19 nt, Artificial Sequence
  Description of Artificial Sequence: Synthetic oligonucleotide
cugaugacagcccucucug

SEQ ID NO: 5572 - RNA, 19 nt, Artificial Sequence
  Description of Artificial Sequence: Synthetic oligonucleotide
cagagagggcugucaucag

SEQ ID NO: 5573 - RNA, 19 nt, Artificial Sequence
  Description of Artificial Sequence: Synthetic oligonucleotide
ugaugacagcccucucuga

SEQ ID NO: 5574 - RNA, 19 nt, Artificial Sequence
  Description of Artificial Sequence: Synthetic oligonucleotide
ucagagagggcugucauca

SEQ ID NO: 5575 - RNA, 19 nt, Artificial Sequence
  Description of Artificial Sequence: Synthetic oligonucleotide
gaugacagcccucucugac

SEQ ID NO: 5576 - RNA, 19 nt, Artificial Sequence
  Description of Artificial Sequence: Synthetic oligonucleotide
gucagagagggcugucauc

SEQ ID NO: 5577 - RNA, 19 nt, Artificial Sequence
  Description of Artificial Sequence: Synthetic oligonucleotide
augacagcccucucugacu

SEQ ID NO: 5578 - RNA, 19 nt, Artificial Sequence
  Description of Artificial Sequence: Synthetic oligonucleotide
agucagagagggcugucau

SEQ ID NO: 5579 - RNA, 19 nt, Artificial Sequence
  Description of Artificial Sequence: Synthetic oligonucleotide
ugacagcccucucugacuu

SEQ ID NO: 5580 - RNA, 19 nt, Artificial Sequence
  Description of Artificial Sequence: Synthetic oligonucleotide
aagucagagagggcuguca

SEQ ID NO: 5581 - RNA, 19 nt, Artificial Sequence
  Description of Artificial Sequence: Synthetic oligonucleotide
gacagcccucucugacuuu

SEQ ID NO: 5582 - RNA, 19 nt, Artificial Sequence
  Description of Artificial Sequence: Synthetic oligonucleotide
aaagucagagagggcuguc

SEQ ID NO: 5583 - RNA, 19 nt, Artificial Sequence
  Description of Artificial Sequence: Synthetic oligonucleotide
acagcccucucugacuuua

SEQ ID NO: 5584 - RNA, 19 nt, Artificial Sequence
  Description of Artificial Sequence: Synthetic oligonucleotide
uaaagucagagagggcugu

SEQ ID NO: 5585 - RNA, 19 nt, Artificial Sequence
  Description of Artificial Sequence: Synthetic oligonucleotide
cagcccucucugacuuuac

SEQ ID NO: 5586 - RNA, 19 nt, Artificial Sequence
  Description of Artificial Sequence: Synthetic oligonucleotide
guaaagucagagagggcug

SEQ ID NO: 5587 - RNA, 19 nt, Artificial Sequence
  Description of Artificial Sequence: Synthetic oligonucleotide
agcccucucugacuuuacc

SEQ ID NO: 5588 - RNA, 19 nt, Artificial Sequence
  Description of Artificial Sequence: Synthetic oligonucleotide
gguaaagucagagagggcu

SEQ ID NO: 5589 - RNA, 19 nt, Artificial Sequence
  Description of Artificial Sequence: Synthetic oligonucleotide
gcccucucugacuuuaccu

SEQ ID NO: 5590 - RNA, 19 nt, Artificial Sequence
  Description of Artificial Sequence: Synthetic oligonucleotide
agguaaagucagagagggc

SEQ ID NO: 5591 - RNA, 19 nt, Artificial Sequence
  Description of Artificial Sequence: Synthetic oligonucleotide
cccucucugacuuuaccuu

SEQ ID NO: 5592 - RNA, 19 nt, Artificial Sequence
  Description of Artificial Sequence: Synthetic oligonucleotide
aagguaaagucagagaggg

SEQ ID NO: 5593 - RNA, 19 nt, Artificial Sequence
  Description of Artificial Sequence: Synthetic oligonucleotide
ccucucugacuuuaccuug

SEQ ID NO: 5594 - RNA, 19 nt, Artificial Sequence
  Description of Artificial Sequence: Synthetic oligonucleotide
caagguaaagucagagagg

SEQ ID NO: 5595 - RNA, 19 nt, Artificial Sequence
  Description of Artificial Sequence: Synthetic oligonucleotide
cucucugacuuuaccuuga

SEQ ID NO: 5596 - RNA, 19 nt, Artificial Sequence
  Description of Artificial Sequence: Synthetic oligonucleotide
ucaagguaaagucagagag

SEQ ID NO: 5597 - RNA, 19 nt, Artificial Sequence
  Description of Artificial Sequence: Synthetic oligonucleotide
agaucugucuucauacccu

SEQ ID NO: 5598 - RNA, 19 nt, Artificial Sequence
  Description of Artificial Sequence: Synthetic oligonucleotide
aggguaugaagacagaucu

SEQ ID NO: 5599 - RNA, 19 nt, Artificial Sequence
  Description of Artificial Sequence: Synthetic oligonucleotide
gaucugucuucauacccuu

SEQ ID NO: 5600 - RNA, 19 nt, Artificial Sequence
  Description of Artificial Sequence: Synthetic oligonucleotide
aaggguaugaagacagauc

SEQ ID NO: 5601 - RNA, 19 nt, Artificial Sequence
  Description of Artificial Sequence: Synthetic oligonucleotide
cugucuucauacccuuccc

SEQ ID NO: 5602 - RNA, 19 nt, Artificial Sequence
  Description of Artificial Sequence: Synthetic oligonucleotide
gggaaggguaugaagacag

SEQ ID NO: 5603 - RNA, 19 nt, Artificial Sequence
  Description of Artificial Sequence: Synthetic oligonucleotide
ccagagcaagccgaaggca

SEQ ID NO: 5604 - RNA, 19 nt, Artificial Sequence
  Description of Artificial Sequence: Synthetic oligonucleotide
ugccuucggcuugcucugg

SEQ ID NO: 5605 - RNA, 19 nt, Artificial Sequence
  Description of Artificial Sequence: Synthetic oligonucleotide
cagagcaagccgaaggcaa

SEQ ID NO: 5606 - RNA, 19 nt, Artificial Sequence
  Description of Artificial Sequence: Synthetic oligonucleotide
uugccuucggcuugcucug

SEQ ID NO: 5607 - RNA, 19 nt, Artificial Sequence
  Description of Artificial Sequence: Synthetic oligonucleotide
agagcaagccgaaggcaag

SEQ ID NO: 5608 - RNA, 19 nt, Artificial Sequence
  Description of Artificial Sequence: Synthetic oligonucleotide
cuugccuucggcuugcucu

SEQ ID NO: 5609 - RNA, 19 nt, Artificial Sequence
  Description of Artificial Sequence: Synthetic oligonucleotide
gagcaagccgaaggcaagc

SEQ ID NO: 5610 - RNA, 19 nt, Artificial Sequence
  Description of Artificial Sequence: Synthetic oligonucleotide
gcuugccuucggcuugcuc

SEQ ID NO: 5611 - RNA, 19 nt, Artificial Sequence
  Description of Artificial Sequence: Synthetic oligonucleotide
agcaagccgaaggcaagca

SEQ ID NO: 5612 - RNA, 19 nt, Artificial Sequence
  Description of Artificial Sequence: Synthetic oligonucleotide
ugcuugccuucggcuugcu

SEQ ID NO: 5613 - RNA, 19 nt, Artificial Sequence
  Description of Artificial Sequence: Synthetic oligonucleotide
gcaagccgaaggcaagcac

SEQ ID NO: 5614 - RNA, 19 nt, Artificial Sequence
  Description of Artificial Sequence: Synthetic oligonucleotide
gugcuugccuucggcuugc

SEQ ID NO: 5615 - RNA, 19 nt, Artificial Sequence
  Description of Artificial Sequence: Synthetic oligonucleotide
caagccgaaggcaagcacg

SEQ ID NO: 5616 - RNA, 19 nt, Artificial Sequence
  Description of Artificial Sequence: Synthetic oligonucleotide
cgugcuugccuucggcuug

SEQ ID NO: 5617 - RNA, 19 nt, Artificial Sequence
  Description of Artificial Sequence: Synthetic oligonucleotide
aagccgaaggcaagcacga

SEQ ID NO: 5618 - RNA, 19 nt, Artificial Sequence
  Description of Artificial Sequence: Synthetic oligonucleotide
ucgugcuugccuucggcuu

SEQ ID NO: 5619 - RNA, 19 nt, Artificial Sequence
  Description of Artificial Sequence: Synthetic oligonucleotide
agccgaaggcaagcacgau

SEQ ID NO: 5620 - RNA, 19 nt, Artificial Sequence
  Description of Artificial Sequence: Synthetic oligonucleotide
aucgugcuugccuucggcu

SEQ ID NO: 5621 - RNA, 19 nt, Artificial Sequence
  Description of Artificial Sequence: Synthetic oligonucleotide
gccgaaggcaagcacgaug

SEQ ID NO: 5622 - RNA, 19 nt, Artificial Sequence
  Description of Artificial Sequence: Synthetic oligonucleotide
caucgugcuugccuucggc

SEQ ID NO: 5623 - RNA, 19 nt, Artificial Sequence
  Description of Artificial Sequence: Synthetic oligonucleotide
aaggcaagcacgauggcgc

SEQ ID NO: 5624 - RNA, 19 nt, Artificial Sequence
  Description of Artificial Sequence: Synthetic oligonucleotide
gcgccaucgugcuugccuu

SEQ ID NO: 5625 - RNA, 19 nt, Artificial Sequence
  Description of Artificial Sequence: Synthetic oligonucleotide
aggcaagcacgauggcgcu

SEQ ID NO: 5626 - RNA, 19 nt, Artificial Sequence
  Description of Artificial Sequence: Synthetic oligonucleotide
agcgccaucgugcuugccu

SEQ ID NO: 5627 - RNA, 19 nt, Artificial Sequence
  Description of Artificial Sequence: Synthetic oligonucleotide
aagcacgauggcgcucacc

SEQ ID NO: 5628 - RNA, 19 nt, Artificial Sequence
  Description of Artificial Sequence: Synthetic oligonucleotide
ggugagcgccaucgugcuu

SEQ ID NO: 5629 - RNA, 19 nt, Artificial Sequence
  Description of Artificial Sequence: Synthetic oligonucleotide
agcacgauggcgcucacca

SEQ ID NO: 5630 - RNA, 19 nt, Artificial Sequence
  Description of Artificial Sequence: Synthetic oligonucleotide
uggugagcgccaucgugcu

SEQ ID NO: 5631 - RNA, 19 nt, Artificial Sequence
  Description of Artificial Sequence: Synthetic oligonucleotide
cuguagcagccgagcauca

SEQ ID NO: 5632 - RNA, 19 nt, Artificial Sequence
  Description of Artificial Sequence: Synthetic oligonucleotide
ugaugcucggcugcuacag

SEQ ID NO: 5633 - RNA, 19 nt, Artificial Sequence
  Description of Artificial Sequence: Synthetic oligonucleotide
agccgagcaucagcccgaa

SEQ ID NO: 5634 - RNA, 19 nt, Artificial Sequence
  Description of Artificial Sequence: Synthetic oligonucleotide
uucgggcugaugcucggcu

SEQ ID NO: 5635 - RNA, 19 nt, Artificial Sequence
  Description of Artificial Sequence: Synthetic oligonucleotide
gucagagucuccaggcuca

SEQ ID NO: 5636 - RNA, 19 nt, Artificial Sequence
  Description of Artificial Sequence: Synthetic oligonucleotide
ugagccuggagacucugac

SEQ ID NO: 5637 - RNA, 19 nt, Artificial Sequence
  Description of Artificial Sequence: Synthetic oligonucleotide
ucagagucuccaggcucag

SEQ ID NO: 5638 - RNA, 19 nt, Artificial Sequence
  Description of Artificial Sequence: Synthetic oligonucleotide
cugagccuggagacucuga

SEQ ID NO: 5639 - RNA, 19 nt, Artificial Sequence
  Description of Artificial Sequence: Synthetic oligonucleotide
cagagucuccaggcucagg

SEQ ID NO: 5640 - RNA, 19 nt, Artificial Sequence
  Description of Artificial Sequence: Synthetic oligonucleotide
ccugagccuggagacucug

SEQ ID NO: 5641 - RNA, 19 nt, Artificial Sequence
  Description of Artificial Sequence: Synthetic oligonucleotide
agagucuccaggcucaggu

SEQ ID NO: 5642 - RNA, 19 nt, Artificial Sequence
  Description of Artificial Sequence: Synthetic oligonucleotide
accugagccuggagacucu

SEQ ID NO: 5643 - RNA, 19 nt, Artificial Sequence
  Description of Artificial Sequence: Synthetic oligonucleotide
gagucuccaggcucaggug

SEQ ID NO: 5644 - RNA, 19 nt, Artificial Sequence
  Description of Artificial Sequence: Synthetic oligonucleotide
caccugagccuggagacuc

SEQ ID NO: 5645 - RNA, 19 nt, Artificial Sequence
  Description of Artificial Sequence: Synthetic oligonucleotide
agucuccaggcucaggugg

SEQ ID NO: 5646 - RNA, 19 nt, Artificial Sequence
  Description of Artificial Sequence: Synthetic oligonucleotide
ccaccugagccuggagacu

SEQ ID NO: 5647 - RNA, 19 nt, Artificial Sequence
  Description of Artificial Sequence: Synthetic oligonucleotide
ggguggcacagcuggcaua

SEQ ID NO: 5648 - RNA, 19 nt, Artificial Sequence
  Description of Artificial Sequence: Synthetic oligonucleotide
uaugccagcugugccaccc

SEQ ID NO: 5649 - RNA, 19 nt, Artificial Sequence
  Description of Artificial Sequence: Synthetic oligonucleotide
guggcacagcuggcauacg

SEQ ID NO: 5650 - RNA, 19 nt, Artificial Sequence
  Description of Artificial Sequence: Synthetic oligonucleotide
cguaugccagcugugccac

SEQ ID NO: 5651 - RNA, 19 nt, Artificial Sequence
  Description of Artificial Sequence: Synthetic oligonucleotide
uggcacagcuggcauacgc

SEQ ID NO: 5652 - RNA, 19 nt, Artificial Sequence
  Description of Artificial Sequence: Synthetic oligonucleotide
gcguaugccagcugugcca

SEQ ID NO: 5653 - RNA, 19 nt, Artificial Sequence
  Description of Artificial Sequence: Synthetic oligonucleotide
cuccacagguggcgguaga

SEQ ID NO: 5654 - RNA, 19 nt, Artificial Sequence
  Description of Artificial Sequence: Synthetic oligonucleotide
ucuaccgccaccuguggag

SEQ ID NO: 5655 - RNA, 19 nt, Artificial Sequence
  Description of Artificial Sequence: Synthetic oligonucleotide
uccacagguggcgguagac

SEQ ID NO: 5656 - RNA, 19 nt, Artificial Sequence
  Description of Artificial Sequence: Synthetic oligonucleotide
gucuaccgccaccugugga

SEQ ID NO: 5657 - RNA, 19 nt, Artificial Sequence
  Description of Artificial Sequence: Synthetic oligonucleotide
ugagcagcacgcuggcgua

SEQ ID NO: 5658 - RNA, 19 nt, Artificial Sequence
  Description of Artificial Sequence: Synthetic oligonucleotide
uacgccagcgugcugcuca

SEQ ID NO: 5659 - RNA, 19 nt, Artificial Sequence
  Description of Artificial Sequence: Synthetic oligonucleotide
agcagcacgcuggcguaca

SEQ ID NO: 5660 - RNA, 19 nt, Artificial Sequence
  Description of Artificial Sequence: Synthetic oligonucleotide
uguacgccagcgugcugcu

SEQ ID NO: 5661 - RNA, 19 nt, Artificial Sequence
  Description of Artificial Sequence: Synthetic oligonucleotide
gcagcacgcuggcguacau

SEQ ID NO: 5662 - RNA, 19 nt, Artificial Sequence
  Description of Artificial Sequence: Synthetic oligonucleotide
auguacgccagcgugcugc

SEQ ID NO: 5663 - RNA, 19 nt, Artificial Sequence
  Description of Artificial Sequence: Synthetic oligonucleotide
cagcacgcuggcguacaug

SEQ ID NO: 5664 - RNA, 19 nt, Artificial Sequence
  Description of Artificial Sequence: Synthetic oligonucleotide
cauguacgccagcgugcug

SEQ ID NO: 5665 - RNA, 19 nt, Artificial Sequence
  Description of Artificial Sequence: Synthetic oligonucleotide
agcacgcuggcguacaugc

SEQ ID NO: 5666 - RNA, 19 nt, Artificial Sequence
  Description of Artificial Sequence: Synthetic oligonucleotide
gcauguacgccagcgugcu

SEQ ID NO: 5667 - RNA, 19 nt, Artificial Sequence
  Description of Artificial Sequence: Synthetic oligonucleotide
gcacgcuggcguacaugcu

SEQ ID NO: 5668 - RNA, 19 nt, Artificial Sequence
  Description of Artificial Sequence: Synthetic oligonucleotide
agcauguacgccagcgugc

SEQ ID NO: 5669 - RNA, 19 nt, Artificial Sequence
  Description of Artificial Sequence: Synthetic oligonucleotide
cacgcuggcguacaugcug

SEQ ID NO: 5670 - RNA, 19 nt, Artificial Sequence
  Description of Artificial Sequence: Synthetic oligonucleotide
cagcauguacgccagcgug

SEQ ID NO: 5671 - RNA, 19 nt, Artificial Sequence
  Description of Artificial Sequence: Synthetic oligonucleotide
acgcuggcguacaugcuga

SEQ ID NO: 5672 - RNA, 19 nt, Artificial Sequence
  Description of Artificial Sequence: Synthetic oligonucleotide
ucagcauguacgccagcgu

SEQ ID NO: 5673 - RNA, 19 nt, Artificial Sequence
  Description of Artificial Sequence: Synthetic oligonucleotide
cuggcguacaugcugagcg

SEQ ID NO: 5674 - RNA, 19 nt, Artificial Sequence
  Description of Artificial Sequence: Synthetic oligonucleotide
cgcucagcauguacgccag

SEQ ID NO: 5675 - RNA, 19 nt, Artificial Sequence
  Description of Artificial Sequence: Synthetic oligonucleotide
uggcguacaugcugagcgc

SEQ ID NO: 5676 - RNA, 19 nt, Artificial Sequence
  Description of Artificial Sequence: Synthetic oligonucleotide
gcgcucagcauguacgcca

SEQ ID NO: 5677 - RNA, 19 nt, Artificial Sequence
  Description of Artificial Sequence: Synthetic oligonucleotide
cgcgcacacguaguacacc

SEQ ID NO: 5678 - RNA, 19 nt, Artificial Sequence
  Description of Artificial Sequence: Synthetic oligonucleotide
gguguacuacgugugcgcg

SEQ ID NO: 5679 - RNA, 19 nt, Artificial Sequence
  Description of Artificial Sequence: Synthetic oligonucleotide
gcgcacacguaguacaccg

SEQ ID NO: 5680 - RNA, 19 nt, Artificial Sequence
  Description of Artificial Sequence: Synthetic oligonucleotide
cgguguacuacgugugcgc

SEQ ID NO: 5681 - RNA, 19 nt, Artificial Sequence
  Description of Artificial Sequence: Synthetic oligonucleotide
cgcacacguaguacaccgc

SEQ ID NO: 5682 - RNA, 19 nt, Artificial Sequence
  Description of Artificial Sequence: Synthetic oligonucleotide
gcgguguacuacgugugcg

SEQ ID NO: 5683 - RNA, 19 nt, Artificial Sequence
  Description of Artificial Sequence: Synthetic oligonucleotide
gcacacguaguacaccgcc

SEQ ID NO: 5684 - RNA, 19 nt, Artificial Sequence
  Description of Artificial Sequence: Synthetic oligonucleotide
ggcgguguacuacgugugc

SEQ ID NO: 5685 - RNA, 19 nt, Artificial Sequence
  Description of Artificial Sequence: Synthetic oligonucleotide
cacacguaguacaccgccu

SEQ ID NO: 5686 - RNA, 19 nt, Artificial Sequence
  Description of Artificial Sequence: Synthetic oligonucleotide
aggcgguguacuacgugug

SEQ ID NO: 5687 - RNA, 19 nt, Artificial Sequence
  Description of Artificial Sequence: Synthetic oligonucleotide
acacguaguacaccgccuu

SEQ ID NO: 5688 - RNA, 19 nt, Artificial Sequence
  Description of Artificial Sequence: Synthetic oligonucleotide
aaggcgguguacuacgugu

SEQ ID NO: 5689 - RNA, 19 nt, Artificial Sequence
  Description of Artificial Sequence: Synthetic oligonucleotide
cacguaguacaccgccuug

SEQ ID NO: 5690 - RNA, 19 nt, Artificial Sequence
  Description of Artificial Sequence: Synthetic oligonucleotide
caaggcgguguacuacgug

SEQ ID NO: 5691 - RNA, 19 nt, Artificial Sequence
  Description of Artificial Sequence: Synthetic oligonucleotide
uaguacaccgccuugcagc

SEQ ID NO: 5692 - RNA, 19 nt, Artificial Sequence
  Description of Artificial Sequence: Synthetic oligonucleotide
gcugcaaggcgguguacua

SEQ ID NO: 5693 - RNA, 19 nt, Artificial Sequence
  Description of Artificial Sequence: Synthetic oligonucleotide
ccaagcuccacaccacgaa

SEQ ID NO: 5694 - RNA, 19 nt, Artificial Sequence
  Description of Artificial Sequence: Synthetic oligonucleotide
uucgugguguggagcuugg

SEQ ID NO: 5695 - RNA, 19 nt, Artificial Sequence
  Description of Artificial Sequence: Synthetic oligonucleotide
caagcuccacaccacgaag

SEQ ID NO: 5696 - RNA, 19 nt, Artificial Sequence
  Description of Artificial Sequence: Synthetic oligonucleotide
cuucgugguguggagcuug

SEQ ID NO: 5697 - RNA, 19 nt, Artificial Sequence
  Description of Artificial Sequence: Synthetic oligonucleotide
aagcuccacaccacgaagc

SEQ ID NO: 5698 - RNA, 19 nt, Artificial Sequence
  Description of Artificial Sequence: Synthetic oligonucleotide
gcuucgugguguggagcuu

SEQ ID NO: 5699 - RNA, 19 nt, Artificial Sequence
  Description of Artificial Sequence: Synthetic oligonucleotide
agcuccacaccacgaagcc

SEQ ID NO: 5700 - RNA, 19 nt, Artificial Sequence
  Description of Artificial Sequence: Synthetic oligonucleotide
ggcuucgugguguggagcu

SEQ ID NO: 5701 - RNA, 19 nt, Artificial Sequence
  Description of Artificial Sequence: Synthetic oligonucleotide
cuccacaccacgaagccgu

SEQ ID NO: 5702 - RNA, 19 nt, Artificial Sequence
  Description of Artificial Sequence: Synthetic oligonucleotide
acggcuucgugguguggag

SEQ ID NO: 5703 - RNA, 19 nt, Artificial Sequence
  Description of Artificial Sequence: Synthetic oligonucleotide
uccacaccacgaagccguu

SEQ ID NO: 5704 - RNA, 19 nt, Artificial Sequence
  Description of Artificial Sequence: Synthetic oligonucleotide
aacggcuucguggugugga

SEQ ID NO: 5705 - RNA, 19 nt, Artificial Sequence
  Description of Artificial Sequence: Synthetic oligonucleotide
ccacaccacgaagccguug

SEQ ID NO: 5706 - RNA, 19 nt, Artificial Sequence
  Description of Artificial Sequence: Synthetic oligonucleotide
caacggcuucguggugugg

SEQ ID NO: 5707 - RNA, 19 nt, Artificial Sequence
  Description of Artificial Sequence: Synthetic oligonucleotide
cacaccacgaagccguugc

SEQ ID NO: 5708 - RNA, 19 nt, Artificial Sequence
  Description of Artificial Sequence: Synthetic oligonucleotide
gcaacggcuucguggugug

SEQ ID NO: 5709 - RNA, 19 nt, Artificial Sequence
  Description of Artificial Sequence: Synthetic oligonucleotide
acaccacgaagccguugcc

SEQ ID NO: 5710 - RNA, 19 nt, Artificial Sequence
  Description of Artificial Sequence: Synthetic oligonucleotide
ggcaacggcuucguggugu

SEQ ID NO: 5711 - RNA, 19 nt, Artificial Sequence
  Description of Artificial Sequence: Synthetic oligonucleotide
caccacgaagccguugcca

SEQ ID NO: 5712 - RNA, 19 nt, Artificial Sequence
  Description of Artificial Sequence: Synthetic oligonucleotide
uggcaacggcuucguggug

SEQ ID NO: 5713 - RNA, 19 nt, Artificial Sequence
  Description of Artificial Sequence: Synthetic oligonucleotide
accacgaagccguugccag

SEQ ID NO: 5714 - RNA, 19 nt, Artificial Sequence
  Description of Artificial Sequence: Synthetic oligonucleotide
cuggcaacggcuucguggu

SEQ ID NO: 5715 - RNA, 19 nt, Artificial Sequence
  Description of Artificial Sequence: Synthetic oligonucleotide
ccgcgaagucuuccagcuc

SEQ ID NO: 5716 - RNA, 19 nt, Artificial Sequence
  Description of Artificial Sequence: Synthetic oligonucleotide
gagcuggaagacuucgcgg

SEQ ID NO: 5717 - RNA, 19 nt, Artificial Sequence
  Description of Artificial Sequence: Synthetic oligonucleotide
cgcgaagucuuccagcuca

SEQ ID NO: 5718 - RNA, 19 nt, Artificial Sequence
  Description of Artificial Sequence: Synthetic oligonucleotide
ugagcuggaagacuucgcg

SEQ ID NO: 5719 - RNA, 19 nt, Artificial Sequence
  Description of Artificial Sequence: Synthetic oligonucleotide
gcgaagucuuccagcucag

SEQ ID NO: 5720 - RNA, 19 nt, Artificial Sequence
  Description of Artificial Sequence: Synthetic oligonucleotide
cugagcuggaagacuucgc

SEQ ID NO: 5721 - RNA, 19 nt, Artificial Sequence
  Description of Artificial Sequence: Synthetic oligonucleotide
uuccagcucagcagugucu

SEQ ID NO: 5722 - RNA, 19 nt, Artificial Sequence
  Description of Artificial Sequence: Synthetic oligonucleotide
agacacugcugagcuggaa

SEQ ID NO: 5723 - RNA, 19 nt, Artificial Sequence
  Description of Artificial Sequence: Synthetic oligonucleotide
uccagcucagcagugucuc

SEQ ID NO: 5724 - RNA, 19 nt, Artificial Sequence
  Description of Artificial Sequence: Synthetic oligonucleotide
gagacacugcugagcugga

SEQ ID NO: 5725 - RNA, 19 nt, Artificial Sequence
  Description of Artificial Sequence: Synthetic oligonucleotide
ccagcucagcagugucucg

SEQ ID NO: 5726 - RNA, 19 nt, Artificial Sequence
  Description of Artificial Sequence: Synthetic oligonucleotide
cgagacacugcugagcugg

SEQ ID NO: 5727 - RNA, 19 nt, Artificial Sequence
  Description of Artificial Sequence: Synthetic oligonucleotide
cagcucagcagugucucgu

SEQ ID NO: 5728 - RNA, 19 nt, Artificial Sequence
  Description of Artificial Sequence: Synthetic oligonucleotide
acgagacacugcugagcug

SEQ ID NO: 5729 - RNA, 19 nt, Artificial Sequence
  Description of Artificial Sequence: Synthetic oligonucleotide
agcucagcagugucucguu

SEQ ID NO: 5730 - RNA, 19 nt, Artificial Sequence
  Description of Artificial Sequence: Synthetic oligonucleotide
aacgagacacugcugagcu

SEQ ID NO: 5731 - RNA, 19 nt, Artificial Sequence
  Description of Artificial Sequence: Synthetic oligonucleotide
gcucagcagugucucguuc

SEQ ID NO: 5732 - RNA, 19 nt, Artificial Sequence
  Description of Artificial Sequence: Synthetic oligonucleotide
gaacgagacacugcugagc

SEQ ID NO: 5733 - RNA, 19 nt, Artificial Sequence
  Description of Artificial Sequence: Synthetic oligonucleotide
cucagcagugucucguucc

SEQ ID NO: 5734 - RNA, 19 nt, Artificial Sequence
  Description of Artificial Sequence: Synthetic oligonucleotide
ggaacgagacacugcugag

SEQ ID NO: 5735 - RNA, 19 nt, Artificial Sequence
  Description of Artificial Sequence: Synthetic oligonucleotide
guagcagaccgacauccuu

SEQ ID NO: 5736 - RNA, 19 nt, Artificial Sequence
  Description of Artificial Sequence: Synthetic oligonucleotide
aaggaugucggucugcuac

SEQ ID NO: 5737 - RNA, 19 nt, Artificial Sequence
  Description of Artificial Sequence: Synthetic oligonucleotide
uagcagaccgacauccuuc

SEQ ID NO: 5738 - RNA, 19 nt, Artificial Sequence
  Description of Artificial Sequence: Synthetic oligonucleotide
gaaggaugucggucugcua

SEQ ID NO: 5739 - RNA, 19 nt, Artificial Sequence
  Description of Artificial Sequence: Synthetic oligonucleotide
agcagaccgacauccuucu

SEQ ID NO: 5740 - RNA, 19 nt, Artificial Sequence
  Description of Artificial Sequence: Synthetic oligonucleotide
agaaggaugucggucugcu

SEQ ID NO: 5741 - RNA, 19 nt, Artificial Sequence
  Description of Artificial Sequence: Synthetic oligonucleotide
agaccgacauccuucuggg

SEQ ID NO: 5742 - RNA, 19 nt, Artificial Sequence
  Description of Artificial Sequence: Synthetic oligonucleotide
cccagaaggaugucggucu

SEQ ID NO: 5743 - RNA, 19 nt, Artificial Sequence
  Description of Artificial Sequence: Synthetic oligonucleotide
gaccgacauccuucugggc

SEQ ID NO: 5744 - RNA, 19 nt, Artificial Sequence
  Description of Artificial Sequence: Synthetic oligonucleotide
gcccagaaggaugucgguc

SEQ ID NO: 5745 - RNA, 19 nt, Artificial Sequence
  Description of Artificial Sequence: Synthetic oligonucleotide
ccgacauccuucugggccu

SEQ ID NO: 5746 - RNA, 19 nt, Artificial Sequence
  Description of Artificial Sequence: Synthetic oligonucleotide
aggcccagaaggaugucgg

SEQ ID NO: 5747 - RNA, 19 nt, Artificial Sequence
  Description of Artificial Sequence: Synthetic oligonucleotide
cgacauccuucugggccua

SEQ ID NO: 5748 - RNA, 19 nt, Artificial Sequence
  Description of Artificial Sequence: Synthetic oligonucleotide
uaggcccagaaggaugucg

SEQ ID NO: 5749 - RNA, 19 nt, Artificial Sequence
  Description of Artificial Sequence: Synthetic oligonucleotide
gacauccuucugggccuac

SEQ ID NO: 5750 - RNA, 19 nt, Artificial Sequence
  Description of Artificial Sequence: Synthetic oligonucleotide
guaggcccagaaggauguc

SEQ ID NO: 5751 - RNA, 19 nt, Artificial Sequence
  Description of Artificial Sequence: Synthetic oligonucleotide
cuucugggccuacaggugg

SEQ ID NO: 5752 - RNA, 19 nt, Artificial Sequence
  Description of Artificial Sequence: Synthetic oligonucleotide
ccaccuguaggcccagaag

SEQ ID NO: 5753 - RNA, 19 nt, Artificial Sequence
  Description of Artificial Sequence: Synthetic oligonucleotide
uucugggccuacagguggg

SEQ ID NO: 5754 - RNA, 19 nt, Artificial Sequence
  Description of Artificial Sequence: Synthetic oligonucleotide
cccaccuguaggcccagaa

SEQ ID NO: 5755 - RNA, 19 nt, Artificial Sequence
  Description of Artificial Sequence: Synthetic oligonucleotide
ucugggccuacaggugggu

SEQ ID NO: 5756 - RNA, 19 nt, Artificial Sequence
  Description of Artificial Sequence: Synthetic oligonucleotide
acccaccuguaggcccaga

SEQ ID NO: 5757 - RNA, 19 nt, Artificial Sequence
  Description of Artificial Sequence: Synthetic oligonucleotide
ggccuacagguggguggaa

SEQ ID NO: 5758 - RNA, 19 nt, Artificial Sequence
  Description of Artificial Sequence: Synthetic oligonucleotide
uuccacccaccuguaggcc

SEQ ID NO: 5759 - RNA, 19 nt, Artificial Sequence
  Description of Artificial Sequence: Synthetic oligonucleotide
ccuacagguggguggaagg

SEQ ID NO: 5760 - RNA, 19 nt, Artificial Sequence
  Description of Artificial Sequence: Synthetic oligonucleotide
ccuuccacccaccuguagg

SEQ ID NO: 5761 - RNA, 19 nt, Artificial Sequence
  Description of Artificial Sequence: Synthetic oligonucleotide
cuacagguggguggaaggc

SEQ ID NO: 5762 - RNA, 19 nt, Artificial Sequence
  Description of Artificial Sequence: Synthetic oligonucleotide
gccuuccacccaccuguag

SEQ ID NO: 5763 - RNA, 19 nt, Artificial Sequence
  Description of Artificial Sequence: Synthetic oligonucleotide
uacagguggguggaaggcg

SEQ ID NO: 5764 - RNA, 19 nt, Artificial Sequence
  Description of Artificial Sequence: Synthetic oligonucleotide
cgccuuccacccaccugua

SEQ ID NO: 5765 - RNA, 19 nt, Artificial Sequence
  Description of Artificial Sequence: Synthetic oligonucleotide
acuucccugcagccugccu

SEQ ID NO: 5766 - RNA, 19 nt, Artificial Sequence
  Description of Artificial Sequence: Synthetic oligonucleotide
aggcaggcugcagggaagu

SEQ ID NO: 5767 - RNA, 19 nt, Artificial Sequence
  Description of Artificial Sequence: Synthetic oligonucleotide
ccugcagccugccucuuuu

SEQ ID NO: 5768 - RNA, 19 nt, Artificial Sequence
  Description of Artificial Sequence: Synthetic oligonucleotide
aaaagaggcaggcugcagg

SEQ ID NO: 5769 - RNA, 19 nt, Artificial Sequence
  Description of Artificial Sequence: Synthetic oligonucleotide
cugcagccugccucuuuuc

SEQ ID NO: 5770 - RNA, 19 nt, Artificial Sequence
  Description of Artificial Sequence: Synthetic oligonucleotide
gaaaagaggcaggcugcag

SEQ ID NO: 5771 - RNA, 19 nt, Artificial Sequence
  Description of Artificial Sequence: Synthetic oligonucleotide
gcagccugccucuuuucug

SEQ ID NO: 5772 - RNA, 19 nt, Artificial Sequence
  Description of Artificial Sequence: Synthetic oligonucleotide
cagaaaagaggcaggcugc

SEQ ID NO: 5773 - RNA, 19 nt, Artificial Sequence
  Description of Artificial Sequence: Synthetic oligonucleotide
cagccugccucuuuucugc

SEQ ID NO: 5774 - RNA, 19 nt, Artificial Sequence
  Description of Artificial Sequence: Synthetic oligonucleotide
gcagaaaagaggcaggcug

SEQ ID NO: 5775 - RNA, 19 nt, Artificial Sequence
  Description of Artificial Sequence: Synthetic oligonucleotide
agccugccucuuuucugcc

SEQ ID NO: 5776 - RNA, 19 nt, Artificial Sequence
  Description of Artificial Sequence: Synthetic oligonucleotide
ggcagaaaagaggcaggcu

SEQ ID NO: 5777 - RNA, 19 nt, Artificial Sequence
  Description of Artificial Sequence: Synthetic oligonucleotide
gccucuuuucugccuggga

SEQ ID NO: 5778 - RNA, 19 nt, Artificial Sequence
  Description of Artificial Sequence: Synthetic oligonucleotide
ucccaggcagaaaagaggc

SEQ ID NO: 5779 - RNA, 19 nt, Artificial Sequence
  Description of Artificial Sequence: Synthetic oligonucleotide
cuuuucugccugggagucc

SEQ ID NO: 5780 - RNA, 19 nt, Artificial Sequence
  Description of Artificial Sequence: Synthetic oligonucleotide
ggacucccaggcagaaaag

SEQ ID NO: 5781 - RNA, 19 nt, Artificial Sequence
  Description of Artificial Sequence: Synthetic oligonucleotide
uuuucugccugggaguccu

SEQ ID NO: 5782 - RNA, 19 nt, Artificial Sequence
  Description of Artificial Sequence: Synthetic oligonucleotide
aggacucccaggcagaaaa

SEQ ID NO: 5783 - RNA, 19 nt, Artificial Sequence
  Description of Artificial Sequence: Synthetic oligonucleotide
uucugccugggaguccuga

SEQ ID NO: 5784 - RNA, 19 nt, Artificial Sequence
  Description of Artificial Sequence: Synthetic oligonucleotide
ucaggacucccaggcagaa

SEQ ID NO: 5785 - RNA, 19 nt, Artificial Sequence
  Description of Artificial Sequence: Synthetic oligonucleotide
ucugccugggaguccugac

SEQ ID NO: 5786 - RNA, 19 nt, Artificial Sequence
  Description of Artificial Sequence: Synthetic oligonucleotide
gucaggacucccaggcaga

SEQ ID NO: 5787 - RNA, 19 nt, Artificial Sequence
  Description of Artificial Sequence: Synthetic oligonucleotide
ugccugggaguccugacuu

SEQ ID NO: 5788 - RNA, 19 nt, Artificial Sequence
  Description of Artificial Sequence: Synthetic oligonucleotide
aagucaggacucccaggca

SEQ ID NO: 5789 - RNA, 19 nt, Artificial Sequence
  Description of Artificial Sequence: Synthetic oligonucleotide
gccugggaguccugacuuc

SEQ ID NO: 5790 - RNA, 19 nt, Artificial Sequence
  Description of Artificial Sequence: Synthetic oligonucleotide
gaagucaggacucccaggc

SEQ ID NO: 5791 - RNA, 19 nt, Artificial Sequence
  Description of Artificial Sequence: Synthetic oligonucleotide
cugggaguccugacuucca

SEQ ID NO: 5792 - RNA, 19 nt, Artificial Sequence
  Description of Artificial Sequence: Synthetic oligonucleotide
uggaagucaggacucccag

SEQ ID NO: 5793 - RNA, 19 nt, Artificial Sequence
  Description of Artificial Sequence: Synthetic oligonucleotide
ugggaguccugacuuccac

SEQ ID NO: 5794 - RNA, 19 nt, Artificial Sequence
  Description of Artificial Sequence: Synthetic oligonucleotide
guggaagucaggacuccca

SEQ ID NO: 5795 - RNA, 19 nt, Artificial Sequence
  Description of Artificial Sequence: Synthetic oligonucleotide
gggaguccugacuuccacg

SEQ ID NO: 5796 - RNA, 19 nt, Artificial Sequence
  Description of Artificial Sequence: Synthetic oligonucleotide
cguggaagucaggacuccc

SEQ ID NO: 5797 - RNA, 19 nt, Artificial Sequence
  Description of Artificial Sequence: Synthetic oligonucleotide
ggaguccugacuuccacga

SEQ ID NO: 5798 - RNA, 19 nt, Artificial Sequence
  Description of Artificial Sequence: Synthetic oligonucleotide
ucguggaagucaggacucc

SEQ ID NO: 5799 - RNA, 19 nt, Artificial Sequence
  Description of Artificial Sequence: Synthetic oligonucleotide
gaguccugacuuccacgag

SEQ ID NO: 5800 - RNA, 19 nt, Artificial Sequence
  Description of Artificial Sequence: Synthetic oligonucleotide
cucguggaagucaggacuc

SEQ ID NO: 5801 - RNA, 19 nt, Artificial Sequence
  Description of Artificial Sequence: Synthetic oligonucleotide
aguccugacuuccacgagg

SEQ ID NO: 5802 - RNA, 19 nt, Artificial Sequence
  Description of Artificial Sequence: Synthetic oligonucleotide
ccucguggaagucaggacu

SEQ ID NO: 5803 - RNA, 19 nt, Artificial Sequence
  Description of Artificial Sequence: Synthetic oligonucleotide
ccugacuuccacgaggacc

SEQ ID NO: 5804 - RNA, 19 nt, Artificial Sequence
  Description of Artificial Sequence: Synthetic oligonucleotide
gguccucguggaagucagg

SEQ ID NO: 5805 - RNA, 19 nt, Artificial Sequence
  Description of Artificial Sequence: Synthetic oligonucleotide
cugacuuccacgaggaccc

SEQ ID NO: 5806 - RNA, 19 nt, Artificial Sequence
  Description of Artificial Sequence: Synthetic oligonucleotide
ggguccucguggaagucag

SEQ ID NO: 5807 - RNA, 19 nt, Artificial Sequence
  Description of Artificial Sequence: Synthetic oligonucleotide
ugacuuccacgaggaccca

SEQ ID NO: 5808 - RNA, 19 nt, Artificial Sequence
  Description of Artificial Sequence: Synthetic oligonucleotide
uggguccucguggaaguca

SEQ ID NO: 5809 - RNA, 19 nt, Artificial Sequence
  Description of Artificial Sequence: Synthetic oligonucleotide
gacuuccacgaggacccag

SEQ ID NO: 5810 - RNA, 19 nt, Artificial Sequence
  Description of Artificial Sequence: Synthetic oligonucleotide
cuggguccucguggaaguc

SEQ ID NO: 5811 - RNA, 19 nt, Artificial Sequence
  Description of Artificial Sequence: Synthetic oligonucleotide
acuuccacgaggacccaga

SEQ ID NO: 5812 - RNA, 19 nt, Artificial Sequence
  Description of Artificial Sequence: Synthetic oligonucleotide
ucuggguccucguggaagu

SEQ ID NO: 5813 - RNA, 19 nt, Artificial Sequence
  Description of Artificial Sequence: Synthetic oligonucleotide
cuuccacgaggacccagac

SEQ ID NO: 5814 - RNA, 19 nt, Artificial Sequence
  Description of Artificial Sequence: Synthetic oligonucleotide
gucuggguccucguggaag

SEQ ID NO: 5815 - RNA, 19 nt, Artificial Sequence
  Description of Artificial Sequence: Synthetic oligonucleotide
uuccacgaggacccagacc

SEQ ID NO: 5816 - RNA, 19 nt, Artificial Sequence
  Description of Artificial Sequence: Synthetic oligonucleotide
ggucuggguccucguggaa

SEQ ID NO: 5817 - RNA, 19 nt, Artificial Sequence
  Description of Artificial Sequence: Synthetic oligonucleotide
cccugcucccagucaguug

SEQ ID NO: 5818 - RNA, 19 nt, Artificial Sequence
  Description of Artificial Sequence: Synthetic oligonucleotide
caacugacugggagcaggg

SEQ ID NO: 5819 - RNA, 19 nt, Artificial Sequence
  Description of Artificial Sequence: Synthetic oligonucleotide
ccugcucccagucaguuga

SEQ ID NO: 5820 - RNA, 19 nt, Artificial Sequence
  Description of Artificial Sequence: Synthetic oligonucleotide
ucaacugacugggagcagg

SEQ ID NO: 5821 - RNA, 19 nt, Artificial Sequence
  Description of Artificial Sequence: Synthetic oligonucleotide
cugcucccagucaguugac

SEQ ID NO: 5822 - RNA, 19 nt, Artificial Sequence
  Description of Artificial Sequence: Synthetic oligonucleotide
gucaacugacugggagcag

SEQ ID NO: 5823 - RNA, 19 nt, Artificial Sequence
  Description of Artificial Sequence: Synthetic oligonucleotide
ugcucccagucaguugacc

SEQ ID NO: 5824 - RNA, 19 nt, Artificial Sequence
  Description of Artificial Sequence: Synthetic oligonucleotide
ggucaacugacugggagca

SEQ ID NO: 5825 - RNA, 19 nt, Artificial Sequence
  Description of Artificial Sequence: Synthetic oligonucleotide
cccagucaguugaccugcc

SEQ ID NO: 5826 - RNA, 19 nt, Artificial Sequence
  Description of Artificial Sequence: Synthetic oligonucleotide
ggcaggucaacugacuggg

SEQ ID NO: 5827 - RNA, 19 nt, Artificial Sequence
  Description of Artificial Sequence: Synthetic oligonucleotide
ccagucaguugaccugccc

SEQ ID NO: 5828 - RNA, 19 nt, Artificial Sequence
  Description of Artificial Sequence: Synthetic oligonucleotide
gggcaggucaacugacugg

SEQ ID NO: 5829 - RNA, 19 nt, Artificial Sequence
  Description of Artificial Sequence: Synthetic oligonucleotide
gccuccuucccagagcuca

SEQ ID NO: 5830 - RNA, 19 nt, Artificial Sequence
  Description of Artificial Sequence: Synthetic oligonucleotide
ugagcucugggaaggaggc

SEQ ID NO: 5831 - RNA, 19 nt, Artificial Sequence
  Description of Artificial Sequence: Synthetic oligonucleotide
ccuccuucccagagcucag

SEQ ID NO: 5832 - RNA, 19 nt, Artificial Sequence
  Description of Artificial Sequence: Synthetic oligonucleotide
cugagcucugggaaggagg

SEQ ID NO: 5833 - RNA, 19 nt, Artificial Sequence
  Description of Artificial Sequence: Synthetic oligonucleotide
cuccuucccagagcucagu

SEQ ID NO: 5834 - RNA, 19 nt, Artificial Sequence
  Description of Artificial Sequence: Synthetic oligonucleotide
acugagcucugggaaggag

SEQ ID NO: 5835 - RNA, 19 nt, Artificial Sequence
  Description of Artificial Sequence: Synthetic oligonucleotide
uccuucccagagcucagug

SEQ ID NO: 5836 - RNA, 19 nt, Artificial Sequence
  Description of Artificial Sequence: Synthetic oligonucleotide
cacugagcucugggaagga

SEQ ID NO: 5837 - RNA, 19 nt, Artificial Sequence
  Description of Artificial Sequence: Synthetic oligonucleotide
ccuucccagagcucagugg

SEQ ID NO: 5838 - RNA, 19 nt, Artificial Sequence
  Description of Artificial Sequence: Synthetic oligonucleotide
ccacugagcucugggaagg

SEQ ID NO: 5839 - RNA, 19 nt, Artificial Sequence
  Description of Artificial Sequence: Synthetic oligonucleotide
uucccagagcucaguggua

SEQ ID NO: 5840 - RNA, 19 nt, Artificial Sequence
  Description of Artificial Sequence: Synthetic oligonucleotide
uaccacugagcucugggaa

SEQ ID NO: 5841 - RNA, 19 nt, Artificial Sequence
  Description of Artificial Sequence: Synthetic oligonucleotide
ucccagagcucagugguaa

SEQ ID NO: 5842 - RNA, 19 nt, Artificial Sequence
  Description of Artificial Sequence: Synthetic oligonucleotide
uuaccacugagcucuggga

SEQ ID NO: 5843 - RNA, 19 nt, Artificial Sequence
  Description of Artificial Sequence: Synthetic oligonucleotide
caggcugucacuaucucua

SEQ ID NO: 5844 - RNA, 19 nt, Artificial Sequence
  Description of Artificial Sequence: Synthetic oligonucleotide
uagagauagugacagccug

SEQ ID NO: 5845 - RNA, 19 nt, Artificial Sequence
  Description of Artificial Sequence: Synthetic oligonucleotide
aggcugucacuaucucuac

SEQ ID NO: 5846 - RNA, 19 nt, Artificial Sequence
  Description of Artificial Sequence: Synthetic oligonucleotide
guagagauagugacagccu

SEQ ID NO: 5847 - RNA, 19 nt, Artificial Sequence
  Description of Artificial Sequence: Synthetic oligonucleotide
ucucuaccaccacuccucu

SEQ ID NO: 5848 - RNA, 19 nt, Artificial Sequence
  Description of Artificial Sequence: Synthetic oligonucleotide
agaggaguggugguagaga

SEQ ID NO: 5849 - RNA, 19 nt, Artificial Sequence
  Description of Artificial Sequence: Synthetic oligonucleotide
ccaccacuccucuagucug

SEQ ID NO: 5850 - RNA, 19 nt, Artificial Sequence
  Description of Artificial Sequence: Synthetic oligonucleotide
cagacuagaggaguggugg

SEQ ID NO: 5851 - RNA, 19 nt, Artificial Sequence
  Description of Artificial Sequence: Synthetic oligonucleotide
caccacuccucuagucugg

SEQ ID NO: 5852 - RNA, 19 nt, Artificial Sequence
  Description of Artificial Sequence: Synthetic oligonucleotide
ccagacuagaggaguggug

SEQ ID NO: 5853 - RNA, 19 nt, Artificial Sequence
  Description of Artificial Sequence: Synthetic oligonucleotide
accacuccucuagucuggc

SEQ ID NO: 5854 - RNA, 19 nt, Artificial Sequence
  Description of Artificial Sequence: Synthetic oligonucleotide
gccagacuagaggaguggu

SEQ ID NO: 5855 - RNA, 19 nt, Artificial Sequence
  Description of Artificial Sequence: Synthetic oligonucleotide
ccacuccucuagucuggcc

SEQ ID NO: 5856 - RNA, 19 nt, Artificial Sequence
  Description of Artificial Sequence: Synthetic oligonucleotide
ggccagacuagaggagugg

SEQ ID NO: 5857 - RNA, 19 nt, Artificial Sequence
  Description of Artificial Sequence: Synthetic oligonucleotide
cacuccucuagucuggccc

SEQ ID NO: 5858 - RNA, 19 nt, Artificial Sequence
  Description of Artificial Sequence: Synthetic oligonucleotide
gggccagacuagaggagug

SEQ ID NO: 5859 - RNA, 19 nt, Artificial Sequence
  Description of Artificial Sequence: Synthetic oligonucleotide
auucuagcacaucugggca

SEQ ID NO: 5860 - RNA, 19 nt, Artificial Sequence
  Description of Artificial Sequence: Synthetic oligonucleotide
ugcccagaugugcuagaau

SEQ ID NO: 5861 - RNA, 19 nt, Artificial Sequence
  Description of Artificial Sequence: Synthetic oligonucleotide
uucuagcacaucugggcaa

SEQ ID NO: 5862 - RNA, 19 nt, Artificial Sequence
  Description of Artificial Sequence: Synthetic oligonucleotide
uugcccagaugugcuagaa

SEQ ID NO: 5863 - RNA, 19 nt, Artificial Sequence
  Description of Artificial Sequence: Synthetic oligonucleotide
ucuagcacaucugggcaaa

SEQ ID NO: 5864 - RNA, 19 nt, Artificial Sequence
  Description of Artificial Sequence: Synthetic oligonucleotide
uuugcccagaugugcuaga

SEQ ID NO: 5865 - RNA, 19 nt, Artificial Sequence
  Description of Artificial Sequence: Synthetic oligonucleotide
cuagcacaucugggcaaaa

SEQ ID NO: 5866 - RNA, 19 nt, Artificial Sequence
  Description of Artificial Sequence: Synthetic oligonucleotide
uuuugcccagaugugcuag

SEQ ID NO: 5867 - RNA, 19 nt, Artificial Sequence
  Description of Artificial Sequence: Synthetic oligonucleotide
ggguguaaagggacgugca

SEQ ID NO: 5868 - RNA, 19 nt, Artificial Sequence
  Description of Artificial Sequence: Synthetic oligonucleotide
ugcacgucccuuuacaccc

SEQ ID NO: 5869 - RNA, 19 nt, Artificial Sequence
  Description of Artificial Sequence: Synthetic oligonucleotide
gguguaaagggacgugcac

SEQ ID NO: 5870 - RNA, 19 nt, Artificial Sequence
  Description of Artificial Sequence: Synthetic oligonucleotide
gugcacgucccuuuacacc

SEQ ID NO: 5871 - RNA, 19 nt, Artificial Sequence
  Description of Artificial Sequence: Synthetic oligonucleotide
guguaaagggacgugcaca

SEQ ID NO: 5872 - RNA, 19 nt, Artificial Sequence
  Description of Artificial Sequence: Synthetic oligonucleotide
ugugcacgucccuuuacac

SEQ ID NO: 5873 - RNA, 19 nt, Artificial Sequence
  Description of Artificial Sequence: Synthetic oligonucleotide
uguaaagggacgugcacag

SEQ ID NO: 5874 - RNA, 19 nt, Artificial Sequence
  Description of Artificial Sequence: Synthetic oligonucleotide
cugugcacgucccuuuaca

SEQ ID NO: 5875 - RNA, 19 nt, Artificial Sequence
  Description of Artificial Sequence: Synthetic oligonucleotide
guaaagggacgugcacaga

SEQ ID NO: 5876 - RNA, 19 nt, Artificial Sequence
  Description of Artificial Sequence: Synthetic oligonucleotide
ucugugcacgucccuuuac

SEQ ID NO: 5877 - RNA, 19 nt, Artificial Sequence
  Description of Artificial Sequence: Synthetic oligonucleotide
uaaagggacgugcacagau

SEQ ID NO: 5878 - RNA, 19 nt, Artificial Sequence
  Description of Artificial Sequence: Synthetic oligonucleotide
aucugugcacgucccuuua

SEQ ID NO: 5879 - RNA, 19 nt, Artificial Sequence
  Description of Artificial Sequence: Synthetic oligonucleotide
aaagggacgugcacagauc

SEQ ID NO: 5880 - RNA, 19 nt, Artificial Sequence
  Description of Artificial Sequence: Synthetic oligonucleotide
gaucugugcacgucccuuu

SEQ ID NO: 5881 - RNA, 19 nt, Artificial Sequence
  Description of Artificial Sequence: Synthetic oligonucleotide
aagggacgugcacagaucu

SEQ ID NO: 5882 - RNA, 19 nt, Artificial Sequence
  Description of Artificial Sequence: Synthetic oligonucleotide
agaucugugcacgucccuu

SEQ ID NO: 5883 - RNA, 19 nt, Artificial Sequence
  Description of Artificial Sequence: Synthetic oligonucleotide
agggacgugcacagaucua

SEQ ID NO: 5884 - RNA, 19 nt, Artificial Sequence
  Description of Artificial Sequence: Synthetic oligonucleotide
uagaucugugcacgucccu

SEQ ID NO: 5885 - RNA, 19 nt, Artificial Sequence
  Description of Artificial Sequence: Synthetic oligonucleotide
cgugcacagaucuacuuac

SEQ ID NO: 5886 - RNA, 19 nt, Artificial Sequence
  Description of Artificial Sequence: Synthetic oligonucleotide
guaaguagaucugugcacg

SEQ ID NO: 5887 - RNA, 19 nt, Artificial Sequence
  Description of Artificial Sequence: Synthetic oligonucleotide
gugcacagaucuacuuacc

SEQ ID NO: 5888 - RNA, 19 nt, Artificial Sequence
  Description of Artificial Sequence: Synthetic oligonucleotide
gguaaguagaucugugcac

SEQ ID NO: 5889 - RNA, 19 nt, Artificial Sequence
  Description of Artificial Sequence: Synthetic oligonucleotide
ugcacagaucuacuuacca

SEQ ID NO: 5890 - RNA, 19 nt, Artificial Sequence
  Description of Artificial Sequence: Synthetic oligonucleotide
ugguaaguagaucugugca

SEQ ID NO: 5891 - RNA, 19 nt, Artificial Sequence
  Description of Artificial Sequence: Synthetic oligonucleotide
gcacagaucuacuuaccaa

SEQ ID NO: 5892 - RNA, 19 nt, Artificial Sequence
  Description of Artificial Sequence: Synthetic oligonucleotide
uugguaaguagaucugugc

SEQ ID NO: 5893 - RNA, 19 nt, Artificial Sequence
  Description of Artificial Sequence: Synthetic oligonucleotide
cacagaucuacuuaccaag

SEQ ID NO: 5894 - RNA, 19 nt, Artificial Sequence
  Description of Artificial Sequence: Synthetic oligonucleotide
cuugguaaguagaucugug

SEQ ID NO: 5895 - RNA, 19 nt, Artificial Sequence
  Description of Artificial Sequence: Synthetic oligonucleotide
acagaucuacuuaccaagc

SEQ ID NO: 5896 - RNA, 19 nt, Artificial Sequence
  Description of Artificial Sequence: Synthetic oligonucleotide
gcuugguaaguagaucugu

SEQ ID NO: 5897 - RNA, 19 nt, Artificial Sequence
  Description of Artificial Sequence: Synthetic oligonucleotide
cagaucuacuuaccaagcu

SEQ ID NO: 5898 - RNA, 19 nt, Artificial Sequence
  Description of Artificial Sequence: Synthetic oligonucleotide
agcuugguaaguagaucug

SEQ ID NO: 5899 - RNA, 19 nt, Artificial Sequence
  Description of Artificial Sequence: Synthetic oligonucleotide
agaucuacuuaccaagcug

SEQ ID NO: 5900 - RNA, 19 nt, Artificial Sequence
  Description of Artificial Sequence: Synthetic oligonucleotide
cagcuugguaaguagaucu

SEQ ID NO: 5901 - RNA, 19 nt, Artificial Sequence
  Description of Artificial Sequence: Synthetic oligonucleotide
aucuacuuaccaagcuggg

SEQ ID NO: 5902 - RNA, 19 nt, Artificial Sequence
  Description of Artificial Sequence: Synthetic oligonucleotide
cccagcuugguaaguagau

SEQ ID NO: 5903 - RNA, 19 nt, Artificial Sequence
  Description of Artificial Sequence: Synthetic oligonucleotide
ucuacuuaccaagcuggga

SEQ ID NO: 5904 - RNA, 19 nt, Artificial Sequence
  Description of Artificial Sequence: Synthetic oligonucleotide
ucccagcuugguaaguaga

SEQ ID NO: 5905 - RNA, 19 nt, Artificial Sequence
  Description of Artificial Sequence: Synthetic oligonucleotide
cuuaccaagcugggagcaa

SEQ ID NO: 5906 - RNA, 19 nt, Artificial Sequence
  Description of Artificial Sequence: Synthetic oligonucleotide
uugcucccagcuugguaag

SEQ ID NO: 5907 - RNA, 19 nt, Artificial Sequence
  Description of Artificial Sequence: Synthetic oligonucleotide
uuaccaagcugggagcaag

SEQ ID NO: 5908 - RNA, 19 nt, Artificial Sequence
  Description of Artificial Sequence: Synthetic oligonucleotide
cuugcucccagcuugguaa

SEQ ID NO: 5909 - RNA, 19 nt, Artificial Sequence
  Description of Artificial Sequence: Synthetic oligonucleotide
uaccaagcugggagcaagc

SEQ ID NO: 5910 - RNA, 19 nt, Artificial Sequence
  Description of Artificial Sequence: Synthetic oligonucleotide
gcuugcucccagcuuggua

SEQ ID NO: 5911 - RNA, 19 nt, Artificial Sequence
  Description of Artificial Sequence: Synthetic oligonucleotide
accaagcugggagcaagca

SEQ ID NO: 5912 - RNA, 19 nt, Artificial Sequence
  Description of Artificial Sequence: Synthetic oligonucleotide
ugcuugcucccagcuuggu

SEQ ID NO: 5913 - RNA, 19 nt, Artificial Sequence
  Description of Artificial Sequence: Synthetic oligonucleotide
gcugggagcaagcaggauu

SEQ ID NO: 5914 - RNA, 19 nt, Artificial Sequence
  Description of Artificial Sequence: Synthetic oligonucleotide
aauccugcuugcucccagc

SEQ ID NO: 5915 - RNA, 19 nt, Artificial Sequence
  Description of Artificial Sequence: Synthetic oligonucleotide
cugggagcaagcaggauug

SEQ ID NO: 5916 - RNA, 19 nt, Artificial Sequence
  Description of Artificial Sequence: Synthetic oligonucleotide
caauccugcuugcucccag

SEQ ID NO: 5917 - RNA, 19 nt, Artificial Sequence
  Description of Artificial Sequence: Synthetic oligonucleotide
ugggagcaagcaggauugg

SEQ ID NO: 5918 - RNA, 19 nt, Artificial Sequence
  Description of Artificial Sequence: Synthetic oligonucleotide
ccaauccugcuugcuccca

SEQ ID NO: 5919 - RNA, 19 nt, Artificial Sequence
  Description of Artificial Sequence: Synthetic oligonucleotide
gggagcaagcaggauuggg

SEQ ID NO: 5920 - RNA, 19 nt, Artificial Sequence
  Description of Artificial Sequence: Synthetic oligonucleotide
cccaauccugcuugcuccc

SEQ ID NO: 5921 - RNA, 19 nt, Artificial Sequence
  Description of Artificial Sequence: Synthetic oligonucleotide
aaagguuaagcagcaguag

SEQ ID NO: 5922 - RNA, 19 nt, Artificial Sequence
  Description of Artificial Sequence: Synthetic oligonucleotide
cuacugcugcuuaaccuuu

SEQ ID NO: 5923 - RNA, 19 nt, Artificial Sequence
  Description of Artificial Sequence: Synthetic oligonucleotide
aagguuaagcagcaguagg

SEQ ID NO: 5924 - RNA, 19 nt, Artificial Sequence
  Description of Artificial Sequence: Synthetic oligonucleotide
ccuacugcugcuuaaccuu

SEQ ID NO: 5925 - RNA, 19 nt, Artificial Sequence
  Description of Artificial Sequence: Synthetic oligonucleotide
agguuaagcagcaguaggc

SEQ ID NO: 5926 - RNA, 19 nt, Artificial Sequence
  Description of Artificial Sequence: Synthetic oligonucleotide
gccuacugcugcuuaaccu

SEQ ID NO: 5927 - RNA, 19 nt, Artificial Sequence
  Description of Artificial Sequence: Synthetic oligonucleotide
ggugccuacuccuguccug

SEQ ID NO: 5928 - RNA, 19 nt, Artificial Sequence
  Description of Artificial Sequence: Synthetic oligonucleotide
caggacaggaguaggcacc

SEQ ID NO: 5929 - RNA, 19 nt, Artificial Sequence
  Description of Artificial Sequence: Synthetic oligonucleotide
gugccuacuccuguccugu

SEQ ID NO: 5930 - RNA, 19 nt, Artificial Sequence
  Description of Artificial Sequence: Synthetic oligonucleotide
acaggacaggaguaggcac

SEQ ID NO: 5931 - RNA, 19 nt, Artificial Sequence
  Description of Artificial Sequence: Synthetic oligonucleotide
ugccuacuccuguccugug

SEQ ID NO: 5932 - RNA, 19 nt, Artificial Sequence
  Description of Artificial Sequence: Synthetic oligonucleotide
cacaggacaggaguaggca

SEQ ID NO: 5933 - RNA, 19 nt, Artificial Sequence
  Description of Artificial Sequence: Synthetic oligonucleotide
gccuacuccuguccugugc

SEQ ID NO: 5934 - RNA, 19 nt, Artificial Sequence
  Description of Artificial Sequence: Synthetic oligonucleotide
gcacaggacaggaguaggc

SEQ ID NO: 5935 - RNA, 19 nt, Artificial Sequence
  Description of Artificial Sequence: Synthetic oligonucleotide
ccuacuccuguccugugcc

SEQ ID NO: 5936 - RNA, 19 nt, Artificial Sequence
  Description of Artificial Sequence: Synthetic oligonucleotide
ggcacaggacaggaguagg

SEQ ID NO: 5937 - RNA, 19 nt, Artificial Sequence
  Description of Artificial Sequence: Synthetic oligonucleotide
cuacuccuguccugugccu

SEQ ID NO: 5938 - RNA, 19 nt, Artificial Sequence
  Description of Artificial Sequence: Synthetic oligonucleotide
aggcacaggacaggaguag

SEQ ID NO: 5939 - RNA, 19 nt, Artificial Sequence
  Description of Artificial Sequence: Synthetic oligonucleotide
uacuccuguccugugccua

SEQ ID NO: 5940 - RNA, 19 nt, Artificial Sequence
  Description of Artificial Sequence: Synthetic oligonucleotide
uaggcacaggacaggagua

SEQ ID NO: 5941 - RNA, 19 nt, Artificial Sequence
  Description of Artificial Sequence: Synthetic oligonucleotide
acuccuguccugugccuau

SEQ ID NO: 5942 - RNA, 19 nt, Artificial Sequence
  Description of Artificial Sequence: Synthetic oligonucleotide
auaggcacaggacaggagu

SEQ ID NO: 5943 - RNA, 19 nt, Artificial Sequence
  Description of Artificial Sequence: Synthetic oligonucleotide
cuccuguccugugccuauc

SEQ ID NO: 5944 - RNA, 19 nt, Artificial Sequence
  Description of Artificial Sequence: Synthetic oligonucleotide
gauaggcacaggacaggag

SEQ ID NO: 5945 - RNA, 19 nt, Artificial Sequence
  Description of Artificial Sequence: Synthetic oligonucleotide
uccuguccugugccuauca

SEQ ID NO: 5946 - RNA, 19 nt, Artificial Sequence
  Description of Artificial Sequence: Synthetic oligonucleotide
ugauaggcacaggacagga

SEQ ID NO: 5947 - RNA, 19 nt, Artificial Sequence
  Description of Artificial Sequence: Synthetic oligonucleotide
gugccuaucacauuugcag

SEQ ID NO: 5948 - RNA, 19 nt, Artificial Sequence
  Description of Artificial Sequence: Synthetic oligonucleotide
cugcaaaugugauaggcac

SEQ ID NO: 5949 - RNA, 19 nt, Artificial Sequence
  Description of Artificial Sequence: Synthetic oligonucleotide
cuaucacauuugcagaggg

SEQ ID NO: 5950 - RNA, 19 nt, Artificial Sequence
  Description of Artificial Sequence: Synthetic oligonucleotide
cccucugcaaaugugauag

SEQ ID NO: 5951 - RNA, 19 nt, Artificial Sequence
  Description of Artificial Sequence: Synthetic oligonucleotide
uaucacauuugcagagggu

SEQ ID NO: 5952 - RNA, 19 nt, Artificial Sequence
  Description of Artificial Sequence: Synthetic oligonucleotide
acccucugcaaaugugaua

SEQ ID NO: 5953 - RNA, 19 nt, Artificial Sequence
  Description of Artificial Sequence: Synthetic oligonucleotide
aucacauuugcagagggua

SEQ ID NO: 5954 - RNA, 19 nt, Artificial Sequence
  Description of Artificial Sequence: Synthetic oligonucleotide
uacccucugcaaaugugau

SEQ ID NO: 5955 - RNA, 19 nt, Artificial Sequence
  Description of Artificial Sequence: Synthetic oligonucleotide
ucacauuugcagaggguaa

SEQ ID NO: 5956 - RNA, 19 nt, Artificial Sequence
  Description of Artificial Sequence: Synthetic oligonucleotide
uuacccucugcaaauguga

SEQ ID NO: 5957 - RNA, 19 nt, Artificial Sequence
  Description of Artificial Sequence: Synthetic oligonucleotide
cacauuugcagaggguaag

SEQ ID NO: 5958 - RNA, 19 nt, Artificial Sequence
  Description of Artificial Sequence: Synthetic oligonucleotide
cuuacccucugcaaaugug

SEQ ID NO: 5959 - RNA, 19 nt, Artificial Sequence
  Description of Artificial Sequence: Synthetic oligonucleotide
acauuugcagaggguaaga

SEQ ID NO: 5960 - RNA, 19 nt, Artificial Sequence
  Description of Artificial Sequence: Synthetic oligonucleotide
ucuuacccucugcaaaugu

SEQ ID NO: 5961 - RNA, 19 nt, Artificial Sequence
  Description of Artificial Sequence: Synthetic oligonucleotide
cucacccugcuccuuccca

SEQ ID NO: 5962 - RNA, 19 nt, Artificial Sequence
  Description of Artificial Sequence: Synthetic oligonucleotide
ugggaaggagcagggugag

SEQ ID NO: 5963 - RNA, 19 nt, Artificial Sequence
  Description of Artificial Sequence: Synthetic oligonucleotide
cacccugcuccuucccauc

SEQ ID NO: 5964 - RNA, 19 nt, Artificial Sequence
  Description of Artificial Sequence: Synthetic oligonucleotide
gaugggaaggagcagggug

SEQ ID NO: 5965 - RNA, 19 nt, Artificial Sequence
  Description of Artificial Sequence: Synthetic oligonucleotide
ccugcuccuucccaucacc

SEQ ID NO: 5966 - RNA, 19 nt, Artificial Sequence
  Description of Artificial Sequence: Synthetic oligonucleotide
ggugaugggaaggagcagg

SEQ ID NO: 5967 - RNA, 19 nt, Artificial Sequence
  Description of Artificial Sequence: Synthetic oligonucleotide
ugcuccuucccaucaccaa

SEQ ID NO: 5968 - RNA, 19 nt, Artificial Sequence
  Description of Artificial Sequence: Synthetic oligonucleotide
uuggugaugggaaggagca

SEQ ID NO: 5969 - RNA, 19 nt, Artificial Sequence
  Description of Artificial Sequence: Synthetic oligonucleotide
caguaagauucccuggugg

SEQ ID NO: 5970 - RNA, 19 nt, Artificial Sequence
  Description of Artificial Sequence: Synthetic oligonucleotide
ccaccagggaaucuuacug

SEQ ID NO: 5971 - RNA, 19 nt, Artificial Sequence
  Description of Artificial Sequence: Synthetic oligonucleotide
aguaagauucccugguggu

SEQ ID NO: 5972 - RNA, 19 nt, Artificial Sequence
  Description of Artificial Sequence: Synthetic oligonucleotide
accaccagggaaucuuacu

SEQ ID NO: 5973 - RNA, 19 nt, Artificial Sequence
  Description of Artificial Sequence: Synthetic oligonucleotide
guaagauucccugguggug

SEQ ID NO: 5974 - RNA, 19 nt, Artificial Sequence
  Description of Artificial Sequence: Synthetic oligonucleotide
caccaccagggaaucuuac

SEQ ID NO: 5975 - RNA, 19 nt, Artificial Sequence
  Description of Artificial Sequence: Synthetic oligonucleotide
uaagauucccugguggugg

SEQ ID NO: 5976 - RNA, 19 nt, Artificial Sequence
  Description of Artificial Sequence: Synthetic oligonucleotide
ccaccaccagggaaucuua

SEQ ID NO: 5977 - RNA, 19 nt, Artificial Sequence
  Description of Artificial Sequence: Synthetic oligonucleotide
aagauucccugguggugga

SEQ ID NO: 5978 - RNA, 19 nt, Artificial Sequence
  Description of Artificial Sequence: Synthetic oligonucleotide
uccaccaccagggaaucuu

SEQ ID NO: 5979 - RNA, 19 nt, Artificial Sequence
  Description of Artificial Sequence: Synthetic oligonucleotide
ucccuggugguggaaggaa

SEQ ID NO: 5980 - RNA, 19 nt, Artificial Sequence
  Description of Artificial Sequence: Synthetic oligonucleotide
uuccuuccaccaccaggga

SEQ ID NO: 5981 - RNA, 19 nt, Artificial Sequence
  Description of Artificial Sequence: Synthetic oligonucleotide
ucugcugaauccugguccu

SEQ ID NO: 5982 - RNA, 19 nt, Artificial Sequence
  Description of Artificial Sequence: Synthetic oligonucleotide
aggaccaggauucagcaga

SEQ ID NO: 5983 - RNA, 19 nt, Artificial Sequence
  Description of Artificial Sequence: Synthetic oligonucleotide
cugcugaauccugguccug

SEQ ID NO: 5984 - RNA, 19 nt, Artificial Sequence
  Description of Artificial Sequence: Synthetic oligonucleotide
caggaccaggauucagcag

SEQ ID NO: 5985 - RNA, 19 nt, Artificial Sequence
  Description of Artificial Sequence: Synthetic oligonucleotide
ugcugaauccugguccugc

SEQ ID NO: 5986 - RNA, 19 nt, Artificial Sequence
  Description of Artificial Sequence: Synthetic oligonucleotide
gcaggaccaggauucagca

SEQ ID NO: 5987 - RNA, 19 nt, Artificial Sequence
  Description of Artificial Sequence: Synthetic oligonucleotide
ugaauccugguccugcuuc

SEQ ID NO: 5988 - RNA, 19 nt, Artificial Sequence
  Description of Artificial Sequence: Synthetic oligonucleotide
gaagcaggaccaggauuca

SEQ ID NO: 5989 - RNA, 19 nt, Artificial Sequence
  Description of Artificial Sequence: Synthetic oligonucleotide
gaauccugguccugcuucu

SEQ ID NO: 5990 - RNA, 19 nt, Artificial Sequence
  Description of Artificial Sequence: Synthetic oligonucleotide
agaagcaggaccaggauuc

SEQ ID NO: 5991 - RNA, 19 nt, Artificial Sequence
  Description of Artificial Sequence: Synthetic oligonucleotide
aauccugguccugcuucug

SEQ ID NO: 5992 - RNA, 19 nt, Artificial Sequence
  Description of Artificial Sequence: Synthetic oligonucleotide
cagaagcaggaccaggauu

SEQ ID NO: 5993 - RNA, 19 nt, Artificial Sequence
  Description of Artificial Sequence: Synthetic oligonucleotide
auccugguccugcuucugu

SEQ ID NO: 5994 - RNA, 19 nt, Artificial Sequence
  Description of Artificial Sequence: Synthetic oligonucleotide
acagaagcaggaccaggau

SEQ ID NO: 5995 - RNA, 19 nt, Artificial Sequence
  Description of Artificial Sequence: Synthetic oligonucleotide
uccugguccugcuucuguu

SEQ ID NO: 5996 - RNA, 19 nt, Artificial Sequence
  Description of Artificial Sequence: Synthetic oligonucleotide
aacagaagcaggaccagga

SEQ ID NO: 5997 - RNA, 19 nt, Artificial Sequence
  Description of Artificial Sequence: Synthetic oligonucleotide
ccugguccugcuucuguuc

SEQ ID NO: 5998 - RNA, 19 nt, Artificial Sequence
  Description of Artificial Sequence: Synthetic oligonucleotide
gaacagaagcaggaccagg

SEQ ID NO: 5999 - RNA, 19 nt, Artificial Sequence
  Description of Artificial Sequence: Synthetic oligonucleotide
cugguccugcuucuguucu

SEQ ID NO: 6000 - RNA, 19 nt, Artificial Sequence
  Description of Artificial Sequence: Synthetic oligonucleotide
agaacagaagcaggaccag

SEQ ID NO: 6001 - RNA, 19 nt, Artificial Sequence
  Description of Artificial Sequence: Synthetic oligonucleotide
uucuguucucaucccuccc

SEQ ID NO: 6002 - RNA, 19 nt, Artificial Sequence
  Description of Artificial Sequence: Synthetic oligonucleotide
gggagggaugagaacagaa

SEQ ID NO: 6003 - RNA, 19 nt, Artificial Sequence
  Description of Artificial Sequence: Synthetic oligonucleotide
cuucugcaguguguauguu

SEQ ID NO: 6004 - RNA, 19 nt, Artificial Sequence
  Description of Artificial Sequence: Synthetic oligonucleotide
aacauacacacugcagaag

SEQ ID NO: 6005 - RNA, 19 nt, Artificial Sequence
  Description of Artificial Sequence: Synthetic oligonucleotide
uucugcaguguguauguug

SEQ ID NO: 6006 - RNA, 19 nt, Artificial Sequence
  Description of Artificial Sequence: Synthetic oligonucleotide
caacauacacacugcagaa

SEQ ID NO: 6007 - RNA, 19 nt, Artificial Sequence
  Description of Artificial Sequence: Synthetic oligonucleotide
ucugcaguguguauguugc

SEQ ID NO: 6008 - RNA, 19 nt, Artificial Sequence
  Description of Artificial Sequence: Synthetic oligonucleotide
gcaacauacacacugcaga

SEQ ID NO: 6009 - RNA, 19 nt, Artificial Sequence
  Description of Artificial Sequence: Synthetic oligonucleotide
cugcaguguguauguugcc

SEQ ID NO: 6010 - RNA, 19 nt, Artificial Sequence
  Description of Artificial Sequence: Synthetic oligonucleotide
ggcaacauacacacugcag

SEQ ID NO: 6011 - RNA, 19 nt, Artificial Sequence
  Description of Artificial Sequence: Synthetic oligonucleotide
ugcaguguguauguugccu

SEQ ID NO: 6012 - RNA, 19 nt, Artificial Sequence
  Description of Artificial Sequence: Synthetic oligonucleotide
aggcaacauacacacugca

SEQ ID NO: 6013 - RNA, 19 nt, Artificial Sequence
  Description of Artificial Sequence: Synthetic oligonucleotide
gcaguguguauguugccug

SEQ ID NO: 6014 - RNA, 19 nt, Artificial Sequence
  Description of Artificial Sequence: Synthetic oligonucleotide
caggcaacauacacacugc

SEQ ID NO: 6015 - RNA, 19 nt, Artificial Sequence
  Description of Artificial Sequence: Synthetic oligonucleotide
caguguguauguugccugg

SEQ ID NO: 6016 - RNA, 19 nt, Artificial Sequence
  Description of Artificial Sequence: Synthetic oligonucleotide
ccaggcaacauacacacug

SEQ ID NO: 6017 - RNA, 19 nt, Artificial Sequence
  Description of Artificial Sequence: Synthetic oligonucleotide
aguguguauguugccuggu

SEQ ID NO: 6018 - RNA, 19 nt, Artificial Sequence
  Description of Artificial Sequence: Synthetic oligonucleotide
accaggcaacauacacacu

SEQ ID NO: 6019 - RNA, 19 nt, Artificial Sequence
  Description of Artificial Sequence: Synthetic oligonucleotide
guguguauguugccugguc

SEQ ID NO: 6020 - RNA, 19 nt, Artificial Sequence
  Description of Artificial Sequence: Synthetic oligonucleotide
gaccaggcaacauacacac

SEQ ID NO: 6021 - RNA, 19 nt, Artificial Sequence
  Description of Artificial Sequence: Synthetic oligonucleotide
uguguauguugccuggucu

SEQ ID NO: 6022 - RNA, 19 nt, Artificial Sequence
  Description of Artificial Sequence: Synthetic oligonucleotide
agaccaggcaacauacaca

SEQ ID NO: 6023 - RNA, 19 nt, Artificial Sequence
  Description of Artificial Sequence: Synthetic oligonucleotide
guguauguugccuggucuc

SEQ ID NO: 6024 - RNA, 19 nt, Artificial Sequence
  Description of Artificial Sequence: Synthetic oligonucleotide
gagaccaggcaacauacac

SEQ ID NO: 6025 - RNA, 19 nt, Artificial Sequence
  Description of Artificial Sequence: Synthetic oligonucleotide
uguauguugccuggucucu

SEQ ID NO: 6026 - RNA, 19 nt, Artificial Sequence
  Description of Artificial Sequence: Synthetic oligonucleotide
agagaccaggcaacauaca

SEQ ID NO: 6027 - RNA, 19 nt, Artificial Sequence
  Description of Artificial Sequence: Synthetic oligonucleotide
guauguugccuggucucuc

SEQ ID NO: 6028 - RNA, 19 nt, Artificial Sequence
  Description of Artificial Sequence: Synthetic oligonucleotide
gagagaccaggcaacauac

SEQ ID NO: 6029 - RNA, 19 nt, Artificial Sequence
  Description of Artificial Sequence: Synthetic oligonucleotide
uauguugccuggucucucu

SEQ ID NO: 6030 - RNA, 19 nt, Artificial Sequence
  Description of Artificial Sequence: Synthetic oligonucleotide
agagagaccaggcaacaua

SEQ ID NO: 6031 - RNA, 19 nt, Artificial Sequence
  Description of Artificial Sequence: Synthetic oligonucleotide
auguugccuggucucucug

SEQ ID NO: 6032 - RNA, 19 nt, Artificial Sequence
  Description of Artificial Sequence: Synthetic oligonucleotide
cagagagaccaggcaacau

SEQ ID NO: 6033 - RNA, 19 nt, Artificial Sequence
  Description of Artificial Sequence: Synthetic oligonucleotide
uguugccuggucucucugg

SEQ ID NO: 6034 - RNA, 19 nt, Artificial Sequence
  Description of Artificial Sequence: Synthetic oligonucleotide
ccagagagaccaggcaaca

SEQ ID NO: 6035 - RNA, 19 nt, Artificial Sequence
  Description of Artificial Sequence: Synthetic oligonucleotide
guugccuggucucucuggc

SEQ ID NO: 6036 - RNA, 19 nt, Artificial Sequence
  Description of Artificial Sequence: Synthetic oligonucleotide
gccagagagaccaggcaac

SEQ ID NO: 6037 - RNA, 19 nt, Artificial Sequence
  Description of Artificial Sequence: Synthetic oligonucleotide
uugccuggucucucuggcc

SEQ ID NO: 6038 - RNA, 19 nt, Artificial Sequence
  Description of Artificial Sequence: Synthetic oligonucleotide
ggccagagagaccaggcaa

SEQ ID NO: 6039 - RNA, 19 nt, Artificial Sequence
  Description of Artificial Sequence: Synthetic oligonucleotide
cuggucucucuggccugca

SEQ ID NO: 6040 - RNA, 19 nt, Artificial Sequence
  Description of Artificial Sequence: Synthetic oligonucleotide
ugcaggccagagagaccag

SEQ ID NO: 6041 - RNA, 19 nt, Artificial Sequence
  Description of Artificial Sequence: Synthetic oligonucleotide
ccugcagaggugacccaaa

SEQ ID NO: 6042 - RNA, 19 nt, Artificial Sequence
  Description of Artificial Sequence: Synthetic oligonucleotide
uuugggucaccucugcagg

SEQ ID NO: 6043 - RNA, 19 nt, Artificial Sequence
  Description of Artificial Sequence: Synthetic oligonucleotide
cugccuuauccuugccugu

SEQ ID NO: 6044 - RNA, 19 nt, Artificial Sequence
  Description of Artificial Sequence: Synthetic oligonucleotide
acaggcaaggauaaggcag

SEQ ID NO: 6045 - RNA, 19 nt, Artificial Sequence
  Description of Artificial Sequence: Synthetic oligonucleotide
ugccuuauccuugccuguu

SEQ ID NO: 6046 - RNA, 19 nt, Artificial Sequence
  Description of Artificial Sequence: Synthetic oligonucleotide
aacaggcaaggauaaggca

SEQ ID NO: 6047 - RNA, 19 nt, Artificial Sequence
  Description of Artificial Sequence: Synthetic oligonucleotide
gccuuauccuugccuguuu

SEQ ID NO: 6048 - RNA, 19 nt, Artificial Sequence
  Description of Artificial Sequence: Synthetic oligonucleotide
aaacaggcaaggauaaggc

SEQ ID NO: 6049 - RNA, 19 nt, Artificial Sequence
  Description of Artificial Sequence: Synthetic oligonucleotide
agucuccugguccggcuga

SEQ ID NO: 6050 - RNA, 19 nt, Artificial Sequence
  Description of Artificial Sequence: Synthetic oligonucleotide
ucagccggaccaggagacu

SEQ ID NO: 6051 - RNA, 19 nt, Artificial Sequence
  Description of Artificial Sequence: Synthetic oligonucleotide
gucaaugacagcuuuucca

SEQ ID NO: 6052 - RNA, 19 nt, Artificial Sequence
  Description of Artificial Sequence: Synthetic oligonucleotide
uggaaaagcugucauugac

SEQ ID NO: 6053 - RNA, 19 nt, Artificial Sequence
  Description of Artificial Sequence: Synthetic oligonucleotide
ugacagcuuuuccauguaa

SEQ ID NO: 6054 - RNA, 19 nt, Artificial Sequence
  Description of Artificial Sequence: Synthetic oligonucleotide
uuacauggaaaagcuguca

SEQ ID NO: 6055 - RNA, 19 nt, Artificial Sequence
  Description of Artificial Sequence: Synthetic oligonucleotide
gacagcuuuuccauguaag

SEQ ID NO: 6056 - RNA, 19 nt, Artificial Sequence
  Description of Artificial Sequence: Synthetic oligonucleotide
cuuacauggaaaagcuguc

SEQ ID NO: 6057 - RNA, 19 nt, Artificial Sequence
  Description of Artificial Sequence: Synthetic oligonucleotide
acagcuuuuccauguaagg

SEQ ID NO: 6058 - RNA, 19 nt, Artificial Sequence
  Description of Artificial Sequence: Synthetic oligonucleotide
ccuuacauggaaaagcugu

SEQ ID NO: 6059 - RNA, 19 nt, Artificial Sequence
  Description of Artificial Sequence: Synthetic oligonucleotide
cagcuuuuccauguaaggc

SEQ ID NO: 6060 - RNA, 19 nt, Artificial Sequence
  Description of Artificial Sequence: Synthetic oligonucleotide
gccuuacauggaaaagcug

SEQ ID NO: 6061 - RNA, 19 nt, Artificial Sequence
  Description of Artificial Sequence: Synthetic oligonucleotide
agcuuuuccauguaaggca

SEQ ID NO: 6062 - RNA, 19 nt, Artificial Sequence
  Description of Artificial Sequence: Synthetic oligonucleotide
ugccuuacauggaaaagcu

SEQ ID NO: 6063 - RNA, 19 nt, Artificial Sequence
  Description of Artificial Sequence: Synthetic oligonucleotide
uguaaggcauggugcuagg

SEQ ID NO: 6064 - RNA, 19 nt, Artificial Sequence
  Description of Artificial Sequence: Synthetic oligonucleotide
ccuagcaccaugccuuaca

SEQ ID NO: 6065 - RNA, 19 nt, Artificial Sequence
  Description of Artificial Sequence: Synthetic oligonucleotide
guaaggcauggugcuaggu

SEQ ID NO: 6066 - RNA, 19 nt, Artificial Sequence
  Description of Artificial Sequence: Synthetic oligonucleotide
accuagcaccaugccuuac

SEQ ID NO: 6067 - RNA, 19 nt, Artificial Sequence
  Description of Artificial Sequence: Synthetic oligonucleotide
uaaggcauggugcuagguu

SEQ ID NO: 6068 - RNA, 19 nt, Artificial Sequence
  Description of Artificial Sequence: Synthetic oligonucleotide
aaccuagcaccaugccuua

SEQ ID NO: 6069 - RNA, 19 nt, Artificial Sequence
  Description of Artificial Sequence: Synthetic oligonucleotide
gcauggugcuagguuccag

SEQ ID NO: 6070 - RNA, 19 nt, Artificial Sequence
  Description of Artificial Sequence: Synthetic oligonucleotide
cuggaaccuagcaccaugc

SEQ ID NO: 6071 - RNA, 19 nt, Artificial Sequence
  Description of Artificial Sequence: Synthetic oligonucleotide
cauggugcuagguuccagg

SEQ ID NO: 6072 - RNA, 19 nt, Artificial Sequence
  Description of Artificial Sequence: Synthetic oligonucleotide
ccuggaaccuagcaccaug

SEQ ID NO: 6073 - RNA, 19 nt, Artificial Sequence
  Description of Artificial Sequence: Synthetic oligonucleotide
auggugcuagguuccagga

SEQ ID NO: 6074 - RNA, 19 nt, Artificial Sequence
  Description of Artificial Sequence: Synthetic oligonucleotide
uccuggaaccuagcaccau

SEQ ID NO: 6075 - RNA, 19 nt, Artificial Sequence
  Description of Artificial Sequence: Synthetic oligonucleotide
uggugcuagguuccaggag

SEQ ID NO: 6076 - RNA, 19 nt, Artificial Sequence
  Description of Artificial Sequence: Synthetic oligonucleotide
cuccuggaaccuagcacca

SEQ ID NO: 6077 - RNA, 19 nt, Artificial Sequence
  Description of Artificial Sequence: Synthetic oligonucleotide
ggugcuagguuccaggagg

SEQ ID NO: 6078 - RNA, 19 nt, Artificial Sequence
  Description of Artificial Sequence: Synthetic oligonucleotide
ccuccuggaaccuagcacc

SEQ ID NO: 6079 - RNA, 19 nt, Artificial Sequence
  Description of Artificial Sequence: Synthetic oligonucleotide
gugcuagguuccaggagga

SEQ ID NO: 6080 - RNA, 19 nt, Artificial Sequence
  Description of Artificial Sequence: Synthetic oligonucleotide
uccuccuggaaccuagcac

SEQ ID NO: 6081 - RNA, 19 nt, Artificial Sequence
  Description of Artificial Sequence: Synthetic oligonucleotide
ugcauggaggcauaauggu

SEQ ID NO: 6082 - RNA, 19 nt, Artificial Sequence
  Description of Artificial Sequence: Synthetic oligonucleotide
accauuaugccuccaugca

SEQ ID NO: 6083 - RNA, 19 nt, Artificial Sequence
  Description of Artificial Sequence: Synthetic oligonucleotide
gcauggaggcauaaugguu

SEQ ID NO: 6084 - RNA, 19 nt, Artificial Sequence
  Description of Artificial Sequence: Synthetic oligonucleotide
aaccauuaugccuccaugc

SEQ ID NO: 6085 - RNA, 19 nt, Artificial Sequence
  Description of Artificial Sequence: Synthetic oligonucleotide
cauggaggcauaaugguua

SEQ ID NO: 6086 - RNA, 19 nt, Artificial Sequence
  Description of Artificial Sequence: Synthetic oligonucleotide
uaaccauuaugccuccaug

SEQ ID NO: 6087 - RNA, 19 nt, Artificial Sequence
  Description of Artificial Sequence: Synthetic oligonucleotide
auggaggcauaaugguuag

SEQ ID NO: 6088 - RNA, 19 nt, Artificial Sequence
  Description of Artificial Sequence: Synthetic oligonucleotide
cuaaccauuaugccuccau

SEQ ID NO: 6089 - RNA, 19 nt, Artificial Sequence
  Description of Artificial Sequence: Synthetic oligonucleotide
uggaggcauaaugguuagg

SEQ ID NO: 6090 - RNA, 19 nt, Artificial Sequence
  Description of Artificial Sequence: Synthetic oligonucleotide
ccuaaccauuaugccucca

SEQ ID NO: 6091 - RNA, 19 nt, Artificial Sequence
  Description of Artificial Sequence: Synthetic oligonucleotide
ggaggcauaaugguuaggg

SEQ ID NO: 6092 - RNA, 19 nt, Artificial Sequence
  Description of Artificial Sequence: Synthetic oligonucleotide
cccuaaccauuaugccucc

SEQ ID NO: 6093 - RNA, 19 nt, Artificial Sequence
  Description of Artificial Sequence: Synthetic oligonucleotide
gaggcauaaugguuaggga

SEQ ID NO: 6094 - RNA, 19 nt, Artificial Sequence
  Description of Artificial Sequence: Synthetic oligonucleotide
ucccuaaccauuaugccuc

SEQ ID NO: 6095 - RNA, 19 nt, Artificial Sequence
  Description of Artificial Sequence: Synthetic oligonucleotide
cauaaugguuagggaguca

SEQ ID NO: 6096 - RNA, 19 nt, Artificial Sequence
  Description of Artificial Sequence: Synthetic oligonucleotide
ugacucccuaaccauuaug

SEQ ID NO: 6097 - RNA, 19 nt, Artificial Sequence
  Description of Artificial Sequence: Synthetic oligonucleotide
auaaugguuagggagucau

SEQ ID NO: 6098 - RNA, 19 nt, Artificial Sequence
  Description of Artificial Sequence: Synthetic oligonucleotide
augacucccuaaccauuau

SEQ ID NO: 6099 - RNA, 19 nt, Artificial Sequence
  Description of Artificial Sequence: Synthetic oligonucleotide
uaaugguuagggagucaug

SEQ ID NO: 6100 - RNA, 19 nt, Artificial Sequence
  Description of Artificial Sequence: Synthetic oligonucleotide
caugacucccuaaccauua

SEQ ID NO: 6101 - RNA, 19 nt, Artificial Sequence
  Description of Artificial Sequence: Synthetic oligonucleotide
gguuagggagucaugacac

SEQ ID NO: 6102 - RNA, 19 nt, Artificial Sequence
  Description of Artificial Sequence: Synthetic oligonucleotide
gugucaugacucccuaacc

SEQ ID NO: 6103 - RNA, 19 nt, Artificial Sequence
  Description of Artificial Sequence: Synthetic oligonucleotide
cauuaccaggcugcaccag

SEQ ID NO: 6104 - RNA, 19 nt, Artificial Sequence
  Description of Artificial Sequence: Synthetic oligonucleotide
cuggugcagccugguaaug

SEQ ID NO: 6105 - RNA, 19 nt, Artificial Sequence
  Description of Artificial Sequence: Synthetic oligonucleotide
auuaccaggcugcaccagg

SEQ ID NO: 6106 - RNA, 19 nt, Artificial Sequence
  Description of Artificial Sequence: Synthetic oligonucleotide
ccuggugcagccugguaau

SEQ ID NO: 6107 - RNA, 19 nt, Artificial Sequence
  Description of Artificial Sequence: Synthetic oligonucleotide
uaccaggcugcaccaggau

SEQ ID NO: 6108 - RNA, 19 nt, Artificial Sequence
  Description of Artificial Sequence: Synthetic oligonucleotide
auccuggugcagccuggua

SEQ ID NO: 6109 - RNA, 19 nt, Artificial Sequence
  Description of Artificial Sequence: Synthetic oligonucleotide
accaggcugcaccaggaua

SEQ ID NO: 6110 - RNA, 19 nt, Artificial Sequence
  Description of Artificial Sequence: Synthetic oligonucleotide
uauccuggugcagccuggu

SEQ ID NO: 6111 - RNA, 19 nt, Artificial Sequence
  Description of Artificial Sequence: Synthetic oligonucleotide
ccaggcugcaccaggauac

SEQ ID NO: 6112 - RNA, 19 nt, Artificial Sequence
  Description of Artificial Sequence: Synthetic oligonucleotide
guauccuggugcagccugg

SEQ ID NO: 6113 - RNA, 19 nt, Artificial Sequence
  Description of Artificial Sequence: Synthetic oligonucleotide
aaaggaugaguagggacau

SEQ ID NO: 6114 - RNA, 19 nt, Artificial Sequence
  Description of Artificial Sequence: Synthetic oligonucleotide
augucccuacucauccuuu

SEQ ID NO: 6115 - RNA, 19 nt, Artificial Sequence
  Description of Artificial Sequence: Synthetic oligonucleotide
aaggaugaguagggacaua

SEQ ID NO: 6116 - RNA, 19 nt, Artificial Sequence
  Description of Artificial Sequence: Synthetic oligonucleotide
uaugucccuacucauccuu

SEQ ID NO: 6117 - RNA, 19 nt, Artificial Sequence
  Description of Artificial Sequence: Synthetic oligonucleotide
aggaugaguagggacauac

SEQ ID NO: 6118 - RNA, 19 nt, Artificial Sequence
  Description of Artificial Sequence: Synthetic oligonucleotide
guaugucccuacucauccu

SEQ ID NO: 6119 - RNA, 19 nt, Artificial Sequence
  Description of Artificial Sequence: Synthetic oligonucleotide
guagggacauacuaagaag

SEQ ID NO: 6120 - RNA, 19 nt, Artificial Sequence
  Description of Artificial Sequence: Synthetic oligonucleotide
cuucuuaguaugucccuac

SEQ ID NO: 6121 - RNA, 19 nt, Artificial Sequence
  Description of Artificial Sequence: Synthetic oligonucleotide
ggacauacuaagaagcagc

SEQ ID NO: 6122 - RNA, 19 nt, Artificial Sequence
  Description of Artificial Sequence: Synthetic oligonucleotide
gcugcuucuuaguaugucc

SEQ ID NO: 6123 - RNA, 19 nt, Artificial Sequence
  Description of Artificial Sequence: Synthetic oligonucleotide
auacuaagaagcagcccuc

SEQ ID NO: 6124 - RNA, 19 nt, Artificial Sequence
  Description of Artificial Sequence: Synthetic oligonucleotide
gagggcugcuucuuaguau

SEQ ID NO: 6125 - RNA, 19 nt, Artificial Sequence
  Description of Artificial Sequence: Synthetic oligonucleotide
uacuaagaagcagcccucu

SEQ ID NO: 6126 - RNA, 19 nt, Artificial Sequence
  Description of Artificial Sequence: Synthetic oligonucleotide
agagggcugcuucuuagua

SEQ ID NO: 6127 - RNA, 19 nt, Artificial Sequence
  Description of Artificial Sequence: Synthetic oligonucleotide
acuaagaagcagcccucuc

SEQ ID NO: 6128 - RNA, 19 nt, Artificial Sequence
  Description of Artificial Sequence: Synthetic oligonucleotide
gagagggcugcuucuuagu

SEQ ID NO: 6129 - RNA, 19 nt, Artificial Sequence
  Description of Artificial Sequence: Synthetic oligonucleotide
agaagcagcccucuccucu

SEQ ID NO: 6130 - RNA, 19 nt, Artificial Sequence
  Description of Artificial Sequence: Synthetic oligonucleotide
agaggagagggcugcuucu

SEQ ID NO: 6131 - RNA, 19 nt, Artificial Sequence
  Description of Artificial Sequence: Synthetic oligonucleotide
gaagcagcccucuccucuu

SEQ ID NO: 6132 - RNA, 19 nt, Artificial Sequence
  Description of Artificial Sequence: Synthetic oligonucleotide
aagaggagagggcugcuuc

SEQ ID NO: 6133 - RNA, 19 nt, Artificial Sequence
  Description of Artificial Sequence: Synthetic oligonucleotide
cagcccucuccucuuggaa

SEQ ID NO: 6134 - RNA, 19 nt, Artificial Sequence
  Description of Artificial Sequence: Synthetic oligonucleotide
uuccaagaggagagggcug

SEQ ID NO: 6135 - RNA, 19 nt, Artificial Sequence
  Description of Artificial Sequence: Synthetic oligonucleotide
gccuggcagauggauagag

SEQ ID NO: 6136 - RNA, 19 nt, Artificial Sequence
  Description of Artificial Sequence: Synthetic oligonucleotide
cucuauccaucugccaggc

SEQ ID NO: 6137 - RNA, 19 nt, Artificial Sequence
  Description of Artificial Sequence: Synthetic oligonucleotide
ccuggcagauggauagagc

SEQ ID NO: 6138 - RNA, 19 nt, Artificial Sequence
  Description of Artificial Sequence: Synthetic oligonucleotide
gcucuauccaucugccagg

SEQ ID NO: 6139 - RNA, 19 nt, Artificial Sequence
  Description of Artificial Sequence: Synthetic oligonucleotide
cuggcagauggauagagcu

SEQ ID NO: 6140 - RNA, 19 nt, Artificial Sequence
  Description of Artificial Sequence: Synthetic oligonucleotide
agcucuauccaucugccag

SEQ ID NO: 6141 - RNA, 19 nt, Artificial Sequence
  Description of Artificial Sequence: Synthetic oligonucleotide
uggcagauggauagagcug

SEQ ID NO: 6142 - RNA, 19 nt, Artificial Sequence
  Description of Artificial Sequence: Synthetic oligonucleotide
cagcucuauccaucugcca

SEQ ID NO: 6143 - RNA, 19 nt, Artificial Sequence
  Description of Artificial Sequence: Synthetic oligonucleotide
ggcagauggauagagcugg

SEQ ID NO: 6144 - RNA, 19 nt, Artificial Sequence
  Description of Artificial Sequence: Synthetic oligonucleotide
ccagcucuauccaucugcc

SEQ ID NO: 6145 - RNA, 19 nt, Artificial Sequence
  Description of Artificial Sequence: Synthetic oligonucleotide
gcagauggauagagcuggg

SEQ ID NO: 6146 - RNA, 19 nt, Artificial Sequence
  Description of Artificial Sequence: Synthetic oligonucleotide
cccagcucuauccaucugc

SEQ ID NO: 6147 - RNA, 19 nt, Artificial Sequence
  Description of Artificial Sequence: Synthetic oligonucleotide
aaaggccucugcucaagua

SEQ ID NO: 6148 - RNA, 19 nt, Artificial Sequence
  Description of Artificial Sequence: Synthetic oligonucleotide
uacuugagcagaggccuuu

SEQ ID NO: 6149 - RNA, 19 nt, Artificial Sequence
  Description of Artificial Sequence: Synthetic oligonucleotide
aaggccucugcucaaguaa

SEQ ID NO: 6150 - RNA, 19 nt, Artificial Sequence
  Description of Artificial Sequence: Synthetic oligonucleotide
uuacuugagcagaggccuu

SEQ ID NO: 6151 - RNA, 19 nt, Artificial Sequence
  Description of Artificial Sequence: Synthetic oligonucleotide
aggccucugcucaaguaac

SEQ ID NO: 6152 - RNA, 19 nt, Artificial Sequence
  Description of Artificial Sequence: Synthetic oligonucleotide
guuacuugagcagaggccu

SEQ ID NO: 6153 - RNA, 19 nt, Artificial Sequence
  Description of Artificial Sequence: Synthetic oligonucleotide
caggagcacugucuuaguu

SEQ ID NO: 6154 - RNA, 19 nt, Artificial Sequence
  Description of Artificial Sequence: Synthetic oligonucleotide
aacuaagacagugcuccug

SEQ ID NO: 6155 - RNA, 19 nt, Artificial Sequence
  Description of Artificial Sequence: Synthetic oligonucleotide
aggagcacugucuuaguuu

SEQ ID NO: 6156 - RNA, 19 nt, Artificial Sequence
  Description of Artificial Sequence: Synthetic oligonucleotide
aaacuaagacagugcuccu

SEQ ID NO: 6157 - RNA, 19 nt, Artificial Sequence
  Description of Artificial Sequence: Synthetic oligonucleotide
ggagcacugucuuaguuug

SEQ ID NO: 6158 - RNA, 19 nt, Artificial Sequence
  Description of Artificial Sequence: Synthetic oligonucleotide
caaacuaagacagugcucc

SEQ ID NO: 6159 - RNA, 19 nt, Artificial Sequence
  Description of Artificial Sequence: Synthetic oligonucleotide
gagcacugucuuaguuugg

SEQ ID NO: 6160 - RNA, 19 nt, Artificial Sequence
  Description of Artificial Sequence: Synthetic oligonucleotide
ccaaacuaagacagugcuc

SEQ ID NO: 6161 - RNA, 19 nt, Artificial Sequence
  Description of Artificial Sequence: Synthetic oligonucleotide
agcacugucuuaguuuggg

SEQ ID NO: 6162 - RNA, 19 nt, Artificial Sequence
  Description of Artificial Sequence: Synthetic oligonucleotide
cccaaacuaagacagugcu

SEQ ID NO: 6163 - RNA, 19 nt, Artificial Sequence
  Description of Artificial Sequence: Synthetic oligonucleotide
guucuuccaaagcagagcu

SEQ ID NO: 6164 - RNA, 19 nt, Artificial Sequence
  Description of Artificial Sequence: Synthetic oligonucleotide
agcucugcuuuggaagaac

SEQ ID NO: 6165 - RNA, 19 nt, Artificial Sequence
  Description of Artificial Sequence: Synthetic oligonucleotide
agcagagcuugagcuaagg

SEQ ID NO: 6166 - RNA, 19 nt, Artificial Sequence
  Description of Artificial Sequence: Synthetic oligonucleotide
ccuuagcucaagcucugcu

SEQ ID NO: 6167 - RNA, 19 nt, Artificial Sequence
  Description of Artificial Sequence: Synthetic oligonucleotide
gcagagcuugagcuaaggg

SEQ ID NO: 6168 - RNA, 19 nt, Artificial Sequence
  Description of Artificial Sequence: Synthetic oligonucleotide
cccuuagcucaagcucugc

SEQ ID NO: 6169 - RNA, 19 nt, Artificial Sequence
  Description of Artificial Sequence: Synthetic oligonucleotide
cagagcuugagcuaagggc

SEQ ID NO: 6170 - RNA, 19 nt, Artificial Sequence
  Description of Artificial Sequence: Synthetic oligonucleotide
gcccuuagcucaagcucug

SEQ ID NO: 6171 - RNA, 19 nt, Artificial Sequence
  Description of Artificial Sequence: Synthetic oligonucleotide
gcuugagcuaagggcuugg

SEQ ID NO: 6172 - RNA, 19 nt, Artificial Sequence
  Description of Artificial Sequence: Synthetic oligonucleotide
ccaagcccuuagcucaagc

SEQ ID NO: 6173 - RNA, 19 nt, Artificial Sequence
  Description of Artificial Sequence: Synthetic oligonucleotide
uugagcuaagggcuugggu

SEQ ID NO: 6174 - RNA, 19 nt, Artificial Sequence
  Description of Artificial Sequence: Synthetic oligonucleotide
acccaagcccuuagcucaa

SEQ ID NO: 6175 - RNA, 19 nt, Artificial Sequence
  Description of Artificial Sequence: Synthetic oligonucleotide
ugagcuaagggcuugggua

SEQ ID NO: 6176 - RNA, 19 nt, Artificial Sequence
  Description of Artificial Sequence: Synthetic oligonucleotide
uacccaagcccuuagcuca

SEQ ID NO: 6177 - RNA, 19 nt, Artificial Sequence
  Description of Artificial Sequence: Synthetic oligonucleotide
gagcuaagggcuuggguac

SEQ ID NO: 6178 - RNA, 19 nt, Artificial Sequence
  Description of Artificial Sequence: Synthetic oligonucleotide
guacccaagcccuuagcuc

SEQ ID NO: 6179 - RNA, 19 nt, Artificial Sequence
  Description of Artificial Sequence: Synthetic oligonucleotide
agcuaagggcuuggguaca

SEQ ID NO: 6180 - RNA, 19 nt, Artificial Sequence
  Description of Artificial Sequence: Synthetic oligonucleotide
uguacccaagcccuuagcu

SEQ ID NO: 6181 - RNA, 19 nt, Artificial Sequence
  Description of Artificial Sequence: Synthetic oligonucleotide
gcuaagggcuuggguacag

SEQ ID NO: 6182 - RNA, 19 nt, Artificial Sequence
  Description of Artificial Sequence: Synthetic oligonucleotide
cuguacccaagcccuuagc

SEQ ID NO: 6183 - RNA, 19 nt, Artificial Sequence
  Description of Artificial Sequence: Synthetic oligonucleotide
agggcuuggguacagguga

SEQ ID NO: 6184 - RNA, 19 nt, Artificial Sequence
  Description of Artificial Sequence: Synthetic oligonucleotide
ucaccuguacccaagcccu

SEQ ID NO: 6185 - RNA, 19 nt, Artificial Sequence
  Description of Artificial Sequence: Synthetic oligonucleotide
gggcuuggguacaggugau

SEQ ID NO: 6186 - RNA, 19 nt, Artificial Sequence
  Description of Artificial Sequence: Synthetic oligonucleotide
aucaccuguacccaagccc

SEQ ID NO: 6187 - RNA, 19 nt, Artificial Sequence
  Description of Artificial Sequence: Synthetic oligonucleotide
ggcuuggguacaggugauc

SEQ ID NO: 6188 - RNA, 19 nt, Artificial Sequence
  Description of Artificial Sequence: Synthetic oligonucleotide
gaucaccuguacccaagcc

SEQ ID NO: 6189 - RNA, 19 nt, Artificial Sequence
  Description of Artificial Sequence: Synthetic oligonucleotide
gcuuggguacaggugaucc

SEQ ID NO: 6190 - RNA, 19 nt, Artificial Sequence
  Description of Artificial Sequence: Synthetic oligonucleotide
ggaucaccuguacccaagc

SEQ ID NO: 6191 - RNA, 19 nt, Artificial Sequence
  Description of Artificial Sequence: Synthetic oligonucleotide
aggugauccuguauucuug

SEQ ID NO: 6192 - RNA, 19 nt, Artificial Sequence
  Description of Artificial Sequence: Synthetic oligonucleotide
caagaauacaggaucaccu

SEQ ID NO: 6193 - RNA, 19 nt, Artificial Sequence
  Description of Artificial Sequence: Synthetic oligonucleotide
ggugauccuguauucuuga

SEQ ID NO: 6194 - RNA, 19 nt, Artificial Sequence
  Description of Artificial Sequence: Synthetic oligonucleotide
ucaagaauacaggaucacc

SEQ ID NO: 6195 - RNA, 19 nt, Artificial Sequence
  Description of Artificial Sequence: Synthetic oligonucleotide
gugauccuguauucuugag

SEQ ID NO: 6196 - RNA, 19 nt, Artificial Sequence
  Description of Artificial Sequence: Synthetic oligonucleotide
cucaagaauacaggaucac

SEQ ID NO: 6197 - RNA, 19 nt, Artificial Sequence
  Description of Artificial Sequence: Synthetic oligonucleotide
ugauccuguauucuugagc

SEQ ID NO: 6198 - RNA, 19 nt, Artificial Sequence
  Description of Artificial Sequence: Synthetic oligonucleotide
gcucaagaauacaggauca

SEQ ID NO: 6199 - RNA, 19 nt, Artificial Sequence
  Description of Artificial Sequence: Synthetic oligonucleotide
uccuguauucuugagcuaa

SEQ ID NO: 6200 - RNA, 19 nt, Artificial Sequence
  Description of Artificial Sequence: Synthetic oligonucleotide
uuagcucaagaauacagga

SEQ ID NO: 6201 - RNA, 19 nt, Artificial Sequence
  Description of Artificial Sequence: Synthetic oligonucleotide
ccuguauucuugagcuaag

SEQ ID NO: 6202 - RNA, 19 nt, Artificial Sequence
  Description of Artificial Sequence: Synthetic oligonucleotide
cuuagcucaagaauacagg

SEQ ID NO: 6203 - RNA, 19 nt, Artificial Sequence
  Description of Artificial Sequence: Synthetic oligonucleotide
uguauucuugagcuaaggg

SEQ ID NO: 6204 - RNA, 19 nt, Artificial Sequence
  Description of Artificial Sequence: Synthetic oligonucleotide
cccuuagcucaagaauaca

SEQ ID NO: 6205 - RNA, 19 nt, Artificial Sequence
  Description of Artificial Sequence: Synthetic oligonucleotide
guauucuugagcuaagggc

SEQ ID NO: 6206 - RNA, 19 nt, Artificial Sequence
  Description of Artificial Sequence: Synthetic oligonucleotide
gcccuuagcucaagaauac

SEQ ID NO: 6207 - RNA, 19 nt, Artificial Sequence
  Description of Artificial Sequence: Synthetic oligonucleotide
ucuugagcuaagggcuugg

SEQ ID NO: 6208 - RNA, 19 nt, Artificial Sequence
  Description of Artificial Sequence: Synthetic oligonucleotide
ccaagcccuuagcucaaga

SEQ ID NO: 6209 - RNA, 19 nt, Artificial Sequence
  Description of Artificial Sequence: Synthetic oligonucleotide
uugagcuaagggcuugggu

SEQ ID NO: 6210 - RNA, 19 nt, Artificial Sequence
  Description of Artificial Sequence: Synthetic oligonucleotide
acccaagcccuuagcucaa

SEQ ID NO: 6211 - RNA, 19 nt, Artificial Sequence
  Description of Artificial Sequence: Synthetic oligonucleotide
ugagcuaagggcuugggua

SEQ ID NO: 6212 - RNA, 19 nt, Artificial Sequence
  Description of Artificial Sequence: Synthetic oligonucleotide
uacccaagcccuuagcuca

SEQ ID NO: 6213 - RNA, 19 nt, Artificial Sequence
  Description of Artificial Sequence: Synthetic oligonucleotide
gagcuaagggcuuggguac

SEQ ID NO: 6214 - RNA, 19 nt, Artificial Sequence
  Description of Artificial Sequence: Synthetic oligonucleotide
guacccaagcccuuagcuc

SEQ ID NO: 6215 - RNA, 19 nt, Artificial Sequence
  Description of Artificial Sequence: Synthetic oligonucleotide
agcuaagggcuuggguaca

SEQ ID NO: 6216 - RNA, 19 nt, Artificial Sequence
  Description of Artificial Sequence: Synthetic oligonucleotide
uguacccaagcccuuagcu

SEQ ID NO: 6217 - RNA, 19 nt, Artificial Sequence
  Description of Artificial Sequence: Synthetic oligonucleotide
gcuaagggcuuggguacag

SEQ ID NO: 6218 - RNA, 19 nt, Artificial Sequence
  Description of Artificial Sequence: Synthetic oligonucleotide
cuguacccaagcccuuagc

SEQ ID NO: 6219 - RNA, 19 nt, Artificial Sequence
  Description of Artificial Sequence: Synthetic oligonucleotide
agggcuuggguacagguga

SEQ ID NO: 6220 - RNA, 19 nt, Artificial Sequence
  Description of Artificial Sequence: Synthetic oligonucleotide
ucaccuguacccaagcccu

SEQ ID NO: 6221 - RNA, 19 nt, Artificial Sequence
  Description of Artificial Sequence: Synthetic oligonucleotide
gggcuuggguacaggugau

SEQ ID NO: 6222 - RNA, 19 nt, Artificial Sequence
  Description of Artificial Sequence: Synthetic oligonucleotide
aucaccuguacccaagccc

SEQ ID NO: 6223 - RNA, 19 nt, Artificial Sequence
  Description of Artificial Sequence: Synthetic oligonucleotide
ggcuuggguacaggugauc

SEQ ID NO: 6224 - RNA, 19 nt, Artificial Sequence
  Description of Artificial Sequence: Synthetic oligonucleotide
gaucaccuguacccaagcc

SEQ ID NO: 6225 - RNA, 19 nt, Artificial Sequence
  Description of Artificial Sequence: Synthetic oligonucleotide
gcuuggguacaggugaucc

SEQ ID NO: 6226 - RNA, 19 nt, Artificial Sequence
  Description of Artificial Sequence: Synthetic oligonucleotide
ggaucaccuguacccaagc

SEQ ID NO: 6227 - RNA, 19 nt, Artificial Sequence
  Description of Artificial Sequence: Synthetic oligonucleotide
aggugauccuguauuuggg

SEQ ID NO: 6228 - RNA, 19 nt, Artificial Sequence
  Description of Artificial Sequence: Synthetic oligonucleotide
cccaaauacaggaucaccu

SEQ ID NO: 6229 - RNA, 19 nt, Artificial Sequence
  Description of Artificial Sequence: Synthetic oligonucleotide
ggugauccuguauuuggga

SEQ ID NO: 6230 - RNA, 19 nt, Artificial Sequence
  Description of Artificial Sequence: Synthetic oligonucleotide
ucccaaauacaggaucacc

SEQ ID NO: 6231 - RNA, 19 nt, Artificial Sequence
  Description of Artificial Sequence: Synthetic oligonucleotide
auccuguauuugggagguu

SEQ ID NO: 6232 - RNA, 19 nt, Artificial Sequence
  Description of Artificial Sequence: Synthetic oligonucleotide
aaccucccaaauacaggau

SEQ ID NO: 6233 - RNA, 19 nt, Artificial Sequence
  Description of Artificial Sequence: Synthetic oligonucleotide
uccuguauuugggagguua

SEQ ID NO: 6234 - RNA, 19 nt, Artificial Sequence
  Description of Artificial Sequence: Synthetic oligonucleotide
uaaccucccaaauacagga

SEQ ID NO: 6235 - RNA, 19 nt, Artificial Sequence
  Description of Artificial Sequence: Synthetic oligonucleotide
ccuguauuugggagguuaa

SEQ ID NO: 6236 - RNA, 19 nt, Artificial Sequence
  Description of Artificial Sequence: Synthetic oligonucleotide
uuaaccucccaaauacagg

SEQ ID NO: 6237 - RNA, 19 nt, Artificial Sequence
  Description of Artificial Sequence: Synthetic oligonucleotide
cuguauuugggagguuaac

SEQ ID NO: 6238 - RNA, 19 nt, Artificial Sequence
  Description of Artificial Sequence: Synthetic oligonucleotide
guuaaccucccaaauacag

SEQ ID NO: 6239 - RNA, 19 nt, Artificial Sequence
  Description of Artificial Sequence: Synthetic oligonucleotide
uguauuugggagguuaacu

SEQ ID NO: 6240 - RNA, 19 nt, Artificial Sequence
  Description of Artificial Sequence: Synthetic oligonucleotide
aguuaaccucccaaauaca

SEQ ID NO: 6241 - RNA, 19 nt, Artificial Sequence
  Description of Artificial Sequence: Synthetic oligonucleotide
guauuugggagguuaacuc

SEQ ID NO: 6242 - RNA, 19 nt, Artificial Sequence
  Description of Artificial Sequence: Synthetic oligonucleotide
gaguuaaccucccaaauac

SEQ ID NO: 6243 - RNA, 19 nt, Artificial Sequence
  Description of Artificial Sequence: Synthetic oligonucleotide
uauuugggagguuaacuca

SEQ ID NO: 6244 - RNA, 19 nt, Artificial Sequence
  Description of Artificial Sequence: Synthetic oligonucleotide
ugaguuaaccucccaaaua

SEQ ID NO: 6245 - RNA, 19 nt, Artificial Sequence
  Description of Artificial Sequence: Synthetic oligonucleotide
ggagguuaacucaggaagu

SEQ ID NO: 6246 - RNA, 19 nt, Artificial Sequence
  Description of Artificial Sequence: Synthetic oligonucleotide
acuuccugaguuaaccucc

SEQ ID NO: 6247 - RNA, 19 nt, Artificial Sequence
  Description of Artificial Sequence: Synthetic oligonucleotide
gagguuaacucaggaagug

SEQ ID NO: 6248 - RNA, 19 nt, Artificial Sequence
  Description of Artificial Sequence: Synthetic oligonucleotide
cacuuccugaguuaaccuc

SEQ ID NO: 6249 - RNA, 19 nt, Artificial Sequence
  Description of Artificial Sequence: Synthetic oligonucleotide
agguuaacucaggaaguga

SEQ ID NO: 6250 - RNA, 19 nt, Artificial Sequence
  Description of Artificial Sequence: Synthetic oligonucleotide
ucacuuccugaguuaaccu

SEQ ID NO: 6251 - RNA, 19 nt, Artificial Sequence
  Description of Artificial Sequence: Synthetic oligonucleotide
ucaggaagugagggcauaa

SEQ ID NO: 6252 - RNA, 19 nt, Artificial Sequence
  Description of Artificial Sequence: Synthetic oligonucleotide
uuaugcccucacuuccuga

SEQ ID NO: 6253 - RNA, 19 nt, Artificial Sequence
  Description of Artificial Sequence: Synthetic oligonucleotide
caggaagugagggcauaag

SEQ ID NO: 6254 - RNA, 19 nt, Artificial Sequence
  Description of Artificial Sequence: Synthetic oligonucleotide
cuuaugcccucacuuccug

SEQ ID NO: 6255 - RNA, 19 nt, Artificial Sequence
  Description of Artificial Sequence: Synthetic oligonucleotide
aggaagugagggcauaagg

SEQ ID NO: 6256 - RNA, 19 nt, Artificial Sequence
  Description of Artificial Sequence: Synthetic oligonucleotide
ccuuaugcccucacuuccu

SEQ ID NO: 6257 - RNA, 19 nt, Artificial Sequence
  Description of Artificial Sequence: Synthetic oligonucleotide
ggaagugagggcauaaggu

SEQ ID NO: 6258 - RNA, 19 nt, Artificial Sequence
  Description of Artificial Sequence: Synthetic oligonucleotide
accuuaugcccucacuucc

SEQ ID NO: 6259 - RNA, 19 nt, Artificial Sequence
  Description of Artificial Sequence: Synthetic oligonucleotide
gaagugagggcauaaggua

SEQ ID NO: 6260 - RNA, 19 nt, Artificial Sequence
  Description of Artificial Sequence: Synthetic oligonucleotide
uaccuuaugcccucacuuc

SEQ ID NO: 6261 - RNA, 19 nt, Artificial Sequence
  Description of Artificial Sequence: Synthetic oligonucleotide
aagugagggcauaagguaa

SEQ ID NO: 6262 - RNA, 19 nt, Artificial Sequence
  Description of Artificial Sequence: Synthetic oligonucleotide
uuaccuuaugcccucacuu

SEQ ID NO: 6263 - RNA, 19 nt, Artificial Sequence
  Description of Artificial Sequence: Synthetic oligonucleotide
agugagggcauaagguaaa

SEQ ID NO: 6264 - RNA, 19 nt, Artificial Sequence
  Description of Artificial Sequence: Synthetic oligonucleotide
uuuaccuuaugcccucacu

SEQ ID NO: 6265 - RNA, 19 nt, Artificial Sequence
  Description of Artificial Sequence: Synthetic oligonucleotide
aaagccauuaagaguaugu

SEQ ID NO: 6266 - RNA, 19 nt, Artificial Sequence
  Description of Artificial Sequence: Synthetic oligonucleotide
acauacucuuaauggcuuu

SEQ ID NO: 6267 - RNA, 19 nt, Artificial Sequence
  Description of Artificial Sequence: Synthetic oligonucleotide
aagccauuaagaguauguu

SEQ ID NO: 6268 - RNA, 19 nt, Artificial Sequence
  Description of Artificial Sequence: Synthetic oligonucleotide
aacauacucuuaauggcuu

SEQ ID NO: 6269 - RNA, 19 nt, Artificial Sequence
  Description of Artificial Sequence: Synthetic oligonucleotide
agccauuaagaguauguua

SEQ ID NO: 6270 - RNA, 19 nt, Artificial Sequence
  Description of Artificial Sequence: Synthetic oligonucleotide
uaacauacucuuaauggcu

SEQ ID NO: 6271 - RNA, 19 nt, Artificial Sequence
  Description of Artificial Sequence: Synthetic oligonucleotide
uaagaguauguuaaguccc

SEQ ID NO: 6272 - RNA, 19 nt, Artificial Sequence
  Description of Artificial Sequence: Synthetic oligonucleotide
gggacuuaacauacucuua

SEQ ID NO: 6273 - RNA, 19 nt, Artificial Sequence
  Description of Artificial Sequence: Synthetic oligonucleotide
aagaguauguuaagucccu

SEQ ID NO: 6274 - RNA, 19 nt, Artificial Sequence
  Description of Artificial Sequence: Synthetic oligonucleotide
agggacuuaacauacucuu

SEQ ID NO: 6275 - RNA, 19 nt, Artificial Sequence
  Description of Artificial Sequence: Synthetic oligonucleotide
agaguauguuaagucccuu

SEQ ID NO: 6276 - RNA, 19 nt, Artificial Sequence
  Description of Artificial Sequence: Synthetic oligonucleotide
aagggacuuaacauacucu

SEQ ID NO: 6277 - RNA, 19 nt, Artificial Sequence
  Description of Artificial Sequence: Synthetic oligonucleotide
gaguauguuaagucccuuc

SEQ ID NO: 6278 - RNA, 19 nt, Artificial Sequence
  Description of Artificial Sequence: Synthetic oligonucleotide
gaagggacuuaacauacuc

SEQ ID NO: 6279 - RNA, 19 nt, Artificial Sequence
  Description of Artificial Sequence: Synthetic oligonucleotide
aguauguuaagucccuuca

SEQ ID NO: 6280 - RNA, 19 nt, Artificial Sequence
  Description of Artificial Sequence: Synthetic oligonucleotide
ugaagggacuuaacauacu

SEQ ID NO: 6281 - RNA, 19 nt, Artificial Sequence
  Description of Artificial Sequence: Synthetic oligonucleotide
guauguuaagucccuucag

SEQ ID NO: 6282 - RNA, 19 nt, Artificial Sequence
  Description of Artificial Sequence: Synthetic oligonucleotide
cugaagggacuuaacauac

SEQ ID NO: 6283 - RNA, 19 nt, Artificial Sequence
  Description of Artificial Sequence: Synthetic oligonucleotide
uauguuaagucccuucagu

SEQ ID NO: 6284 - RNA, 19 nt, Artificial Sequence
  Description of Artificial Sequence: Synthetic oligonucleotide
acugaagggacuuaacaua

SEQ ID NO: 6285 - RNA, 19 nt, Artificial Sequence
  Description of Artificial Sequence: Synthetic oligonucleotide
auguuaagucccuucagua

SEQ ID NO: 6286 - RNA, 19 nt, Artificial Sequence
  Description of Artificial Sequence: Synthetic oligonucleotide
uacugaagggacuuaacau

SEQ ID NO: 6287 - RNA, 19 nt, Artificial Sequence
  Description of Artificial Sequence: Synthetic oligonucleotide
uguuaagucccuucaguag

SEQ ID NO: 6288 - RNA, 19 nt, Artificial Sequence
  Description of Artificial Sequence: Synthetic oligonucleotide
cuacugaagggacuuaaca

SEQ ID NO: 6289 - RNA, 19 nt, Artificial Sequence
  Description of Artificial Sequence: Synthetic oligonucleotide
guuaagucccuucaguagg

SEQ ID NO: 6290 - RNA, 19 nt, Artificial Sequence
  Description of Artificial Sequence: Synthetic oligonucleotide
ccuacugaagggacuuaac

SEQ ID NO: 6291 - RNA, 19 nt, Artificial Sequence
  Description of Artificial Sequence: Synthetic oligonucleotide
uuaagucccuucaguaggc

SEQ ID NO: 6292 - RNA, 19 nt, Artificial Sequence
  Description of Artificial Sequence: Synthetic oligonucleotide
gccuacugaagggacuuaa

SEQ ID NO: 6293 - RNA, 19 nt, Artificial Sequence
  Description of Artificial Sequence: Synthetic oligonucleotide
uaagucccuucaguaggcc

SEQ ID NO: 6294 - RNA, 19 nt, Artificial Sequence
  Description of Artificial Sequence: Synthetic oligonucleotide
ggccuacugaagggacuua

SEQ ID NO: 6295 - RNA, 19 nt, Artificial Sequence
  Description of Artificial Sequence: Synthetic oligonucleotide
aagucccuucaguaggccu

SEQ ID NO: 6296 - RNA, 19 nt, Artificial Sequence
  Description of Artificial Sequence: Synthetic oligonucleotide
aggccuacugaagggacuu

SEQ ID NO: 6297 - RNA, 19 nt, Artificial Sequence
  Description of Artificial Sequence: Synthetic oligonucleotide
agucccuucaguaggccuu

SEQ ID NO: 6298 - RNA, 19 nt, Artificial Sequence
  Description of Artificial Sequence: Synthetic oligonucleotide
aaggccuacugaagggacu

SEQ ID NO: 6299 - RNA, 19 nt, Artificial Sequence
  Description of Artificial Sequence: Synthetic oligonucleotide
gucccuucaguaggccuug

SEQ ID NO: 6300 - RNA, 19 nt, Artificial Sequence
  Description of Artificial Sequence: Synthetic oligonucleotide
caaggccuacugaagggac

SEQ ID NO: 6301 - RNA, 19 nt, Artificial Sequence
  Description of Artificial Sequence: Synthetic oligonucleotide
ucccuucaguaggccuugg

SEQ ID NO: 6302 - RNA, 19 nt, Artificial Sequence
  Description of Artificial Sequence: Synthetic oligonucleotide
ccaaggccuacugaaggga

SEQ ID NO: 6303 - RNA, 19 nt, Artificial Sequence
  Description of Artificial Sequence: Synthetic oligonucleotide
cccuucaguaggccuuggg

SEQ ID NO: 6304 - RNA, 19 nt, Artificial Sequence
  Description of Artificial Sequence: Synthetic oligonucleotide
cccaaggccuacugaaggg

SEQ ID NO: 6305 - RNA, 19 nt, Artificial Sequence
  Description of Artificial Sequence: Synthetic oligonucleotide
ccuucaguaggccuuggga

SEQ ID NO: 6306 - RNA, 19 nt, Artificial Sequence
  Description of Artificial Sequence: Synthetic oligonucleotide
ucccaaggccuacugaagg

SEQ ID NO: 6307 - RNA, 19 nt, Artificial Sequence
  Description of Artificial Sequence: Synthetic oligonucleotide
cuucaguaggccuugggaa

SEQ ID NO: 6308 - RNA, 19 nt, Artificial Sequence
  Description of Artificial Sequence: Synthetic oligonucleotide
uucccaaggccuacugaag

SEQ ID NO: 6309 - RNA, 19 nt, Artificial Sequence
  Description of Artificial Sequence: Synthetic oligonucleotide
aaaaguauagauugcccaa

SEQ ID NO: 6310 - RNA, 19 nt, Artificial Sequence
  Description of Artificial Sequence: Synthetic oligonucleotide
uugggcaaucuauacuuuu

SEQ ID NO: 6311 - RNA, 19 nt, Artificial Sequence
  Description of Artificial Sequence: Synthetic oligonucleotide
aaaguauagauugcccaag

SEQ ID NO: 6312 - RNA, 19 nt, Artificial Sequence
  Description of Artificial Sequence: Synthetic oligonucleotide
cuugggcaaucuauacuuu

SEQ ID NO: 6313 - RNA, 19 nt, Artificial Sequence
  Description of Artificial Sequence: Synthetic oligonucleotide
aaguauagauugcccaaga

SEQ ID NO: 6314 - RNA, 19 nt, Artificial Sequence
  Description of Artificial Sequence: Synthetic oligonucleotide
ucuugggcaaucuauacuu

SEQ ID NO: 6315 - RNA, 19 nt, Artificial Sequence
  Description of Artificial Sequence: Synthetic oligonucleotide
aaagacuggcagggugauc

SEQ ID NO: 6316 - RNA, 19 nt, Artificial Sequence
  Description of Artificial Sequence: Synthetic oligonucleotide
gaucacccugccagucuuu

SEQ ID NO: 6317 - RNA, 19 nt, Artificial Sequence
  Description of Artificial Sequence: Synthetic oligonucleotide
aagacuggcagggugauca

SEQ ID NO: 6318 - RNA, 19 nt, Artificial Sequence
  Description of Artificial Sequence: Synthetic oligonucleotide
ugaucacccugccagucuu

SEQ ID NO: 6319 - RNA, 19 nt, Artificial Sequence
  Description of Artificial Sequence: Synthetic oligonucleotide
cuggcagggugaucagucc

SEQ ID NO: 6320 - RNA, 19 nt, Artificial Sequence
  Description of Artificial Sequence: Synthetic oligonucleotide
ggacugaucacccugccag

SEQ ID NO: 6321 - RNA, 19 nt, Artificial Sequence
  Description of Artificial Sequence: Synthetic oligonucleotide
gaauguacuuaaugagugg

SEQ ID NO: 6322 - RNA, 19 nt, Artificial Sequence
  Description of Artificial Sequence: Synthetic oligonucleotide
ccacucauuaaguacauuc

SEQ ID NO: 6323 - RNA, 19 nt, Artificial Sequence
  Description of Artificial Sequence: Synthetic oligonucleotide
aauguacuuaaugaguggg

SEQ ID NO: 6324 - RNA, 19 nt, Artificial Sequence
  Description of Artificial Sequence: Synthetic oligonucleotide
cccacucauuaaguacauu

SEQ ID NO: 6325 - RNA, 19 nt, Artificial Sequence
  Description of Artificial Sequence: Synthetic oligonucleotide
uguacuuaaugagugggcu

SEQ ID NO: 6326 - RNA, 19 nt, Artificial Sequence
  Description of Artificial Sequence: Synthetic oligonucleotide
agcccacucauuaaguaca

SEQ ID NO: 6327 - RNA, 19 nt, Artificial Sequence
  Description of Artificial Sequence: Synthetic oligonucleotide
guacuuaaugagugggcua

SEQ ID NO: 6328 - RNA, 19 nt, Artificial Sequence
  Description of Artificial Sequence: Synthetic oligonucleotide
uagcccacucauuaaguac

SEQ ID NO: 6329 - RNA, 19 nt, Artificial Sequence
  Description of Artificial Sequence: Synthetic oligonucleotide
uacuuaaugagugggcuac

SEQ ID NO: 6330 - RNA, 19 nt, Artificial Sequence
  Description of Artificial Sequence: Synthetic oligonucleotide
guagcccacucauuaagua

SEQ ID NO: 6331 - RNA, 19 nt, Artificial Sequence
  Description of Artificial Sequence: Synthetic oligonucleotide
cuuaaugagugggcuacag

SEQ ID NO: 6332 - RNA, 19 nt, Artificial Sequence
  Description of Artificial Sequence: Synthetic oligonucleotide
cuguagcccacucauuaag

SEQ ID NO: 6333 - RNA, 19 nt, Artificial Sequence
  Description of Artificial Sequence: Synthetic oligonucleotide
uaaugagugggcuacagcg

SEQ ID NO: 6334 - RNA, 19 nt, Artificial Sequence
  Description of Artificial Sequence: Synthetic oligonucleotide
cgcuguagcccacucauua

SEQ ID NO: 6335 - RNA, 19 nt, Artificial Sequence
  Description of Artificial Sequence: Synthetic oligonucleotide
aaugagugggcuacagcgu

SEQ ID NO: 6336 - RNA, 19 nt, Artificial Sequence
  Description of Artificial Sequence: Synthetic oligonucleotide
acgcuguagcccacucauu

SEQ ID NO: 6337 - RNA, 19 nt, Artificial Sequence
  Description of Artificial Sequence: Synthetic oligonucleotide
augagugggcuacagcgua

SEQ ID NO: 6338 - RNA, 19 nt, Artificial Sequence
  Description of Artificial Sequence: Synthetic oligonucleotide
uacgcuguagcccacucau

SEQ ID NO: 6339 - RNA, 19 nt, Artificial Sequence
  Description of Artificial Sequence: Synthetic oligonucleotide
ugagugggcuacagcguau

SEQ ID NO: 6340 - RNA, 19 nt, Artificial Sequence
  Description of Artificial Sequence: Synthetic oligonucleotide
auacgcuguagcccacuca

SEQ ID NO: 6341 - RNA, 19 nt, Artificial Sequence
  Description of Artificial Sequence: Synthetic oligonucleotide
gagugggcuacagcguauc

SEQ ID NO: 6342 - RNA, 19 nt, Artificial Sequence
  Description of Artificial Sequence: Synthetic oligonucleotide
gauacgcuguagcccacuc

SEQ ID NO: 6343 - RNA, 19 nt, Artificial Sequence
  Description of Artificial Sequence: Synthetic oligonucleotide
agugggcuacagcguaucc

SEQ ID NO: 6344 - RNA, 19 nt, Artificial Sequence
  Description of Artificial Sequence: Synthetic oligonucleotide
ggauacgcuguagcccacu

SEQ ID NO: 6345 - RNA, 19 nt, Artificial Sequence
  Description of Artificial Sequence: Synthetic oligonucleotide
gugggcuacagcguauccu

SEQ ID NO: 6346 - RNA, 19 nt, Artificial Sequence
  Description of Artificial Sequence: Synthetic oligonucleotide
aggauacgcuguagcccac

SEQ ID NO: 6347 - RNA, 19 nt, Artificial Sequence
  Description of Artificial Sequence: Synthetic oligonucleotide
ugggcuacagcguauccuc

SEQ ID NO: 6348 - RNA, 19 nt, Artificial Sequence
  Description of Artificial Sequence: Synthetic oligonucleotide
gaggauacgcuguagccca

SEQ ID NO: 6349 - RNA, 19 nt, Artificial Sequence
  Description of Artificial Sequence: Synthetic oligonucleotide
agaguuguucuaccugggu

SEQ ID NO: 6350 - RNA, 19 nt, Artificial Sequence
  Description of Artificial Sequence: Synthetic oligonucleotide
acccagguagaacaacucu

SEQ ID NO: 6351 - RNA, 19 nt, Artificial Sequence
  Description of Artificial Sequence: Synthetic oligonucleotide
gaguuguucuaccugggua

SEQ ID NO: 6352 - RNA, 19 nt, Artificial Sequence
  Description of Artificial Sequence: Synthetic oligonucleotide
uacccagguagaacaacuc

SEQ ID NO: 6353 - RNA, 19 nt, Artificial Sequence
  Description of Artificial Sequence: Synthetic oligonucleotide
aguuguucuaccuggguau

SEQ ID NO: 6354 - RNA, 19 nt, Artificial Sequence
  Description of Artificial Sequence: Synthetic oligonucleotide
auacccagguagaacaacu

SEQ ID NO: 6355 - RNA, 19 nt, Artificial Sequence
  Description of Artificial Sequence: Synthetic oligonucleotide
guuguucuaccuggguaua

SEQ ID NO: 6356 - RNA, 19 nt, Artificial Sequence
  Description of Artificial Sequence: Synthetic oligonucleotide
uauacccagguagaacaac

SEQ ID NO: 6357 - RNA, 19 nt, Artificial Sequence
  Description of Artificial Sequence: Synthetic oligonucleotide
uuguucuaccuggguauau

SEQ ID NO: 6358 - RNA, 19 nt, Artificial Sequence
  Description of Artificial Sequence: Synthetic oligonucleotide
auauacccagguagaacaa

SEQ ID NO: 6359 - RNA, 19 nt, Artificial Sequence
  Description of Artificial Sequence: Synthetic oligonucleotide
uguucuaccuggguauauc

SEQ ID NO: 6360 - RNA, 19 nt, Artificial Sequence
  Description of Artificial Sequence: Synthetic oligonucleotide
gauauacccagguagaaca

SEQ ID NO: 6361 - RNA, 19 nt, Artificial Sequence
  Description of Artificial Sequence: Synthetic oligonucleotide
guucuaccuggguauaucc

SEQ ID NO: 6362 - RNA, 19 nt, Artificial Sequence
  Description of Artificial Sequence: Synthetic oligonucleotide
ggauauacccagguagaac

SEQ ID NO: 6363 - RNA, 19 nt, Artificial Sequence
  Description of Artificial Sequence: Synthetic oligonucleotide
uaccuggguauauccaaaa

SEQ ID NO: 6364 - RNA, 19 nt, Artificial Sequence
  Description of Artificial Sequence: Synthetic oligonucleotide
uuuuggauauacccaggua

SEQ ID NO: 6365 - RNA, 19 nt, Artificial Sequence
  Description of Artificial Sequence: Synthetic oligonucleotide
aggguauggaguuuacgag

SEQ ID NO: 6366 - RNA, 19 nt, Artificial Sequence
  Description of Artificial Sequence: Synthetic oligonucleotide
cucguaaacuccauacccu

SEQ ID NO: 6367 - RNA, 19 nt, Artificial Sequence
  Description of Artificial Sequence: Synthetic oligonucleotide
ggguauggaguuuacgagg

SEQ ID NO: 6368 - RNA, 19 nt, Artificial Sequence
  Description of Artificial Sequence: Synthetic oligonucleotide
ccucguaaacuccauaccc

SEQ ID NO: 6369 - RNA, 19 nt, Artificial Sequence
  Description of Artificial Sequence: Synthetic oligonucleotide
gguauggaguuuacgaggg

SEQ ID NO: 6370 - RNA, 19 nt, Artificial Sequence
  Description of Artificial Sequence: Synthetic oligonucleotide
cccucguaaacuccauacc

SEQ ID NO: 6371 - RNA, 19 nt, Artificial Sequence
  Description of Artificial Sequence: Synthetic oligonucleotide
guauggaguuuacgagggu

SEQ ID NO: 6372 - RNA, 19 nt, Artificial Sequence
  Description of Artificial Sequence: Synthetic oligonucleotide
acccucguaaacuccauac

SEQ ID NO: 6373 - RNA, 19 nt, Artificial Sequence
  Description of Artificial Sequence: Synthetic oligonucleotide
uauggaguuuacgaggguu

SEQ ID NO: 6374 - RNA, 19 nt, Artificial Sequence
  Description of Artificial Sequence: Synthetic oligonucleotide
aacccucguaaacuccaua

SEQ ID NO: 6375 - RNA, 19 nt, Artificial Sequence
  Description of Artificial Sequence: Synthetic oligonucleotide
auggaguuuacgaggguuc

SEQ ID NO: 6376 - RNA, 19 nt, Artificial Sequence
  Description of Artificial Sequence: Synthetic oligonucleotide
gaacccucguaaacuccau

SEQ ID NO: 6377 - RNA, 19 nt, Artificial Sequence
  Description of Artificial Sequence: Synthetic oligonucleotide
uggaguuuacgaggguuca

SEQ ID NO: 6378 - RNA, 19 nt, Artificial Sequence
  Description of Artificial Sequence: Synthetic oligonucleotide
ugaacccucguaaacucca

SEQ ID NO: 6379 - RNA, 19 nt, Artificial Sequence
  Description of Artificial Sequence: Synthetic oligonucleotide
ggaguuuacgaggguucaa

SEQ ID NO: 6380 - RNA, 19 nt, Artificial Sequence
  Description of Artificial Sequence: Synthetic oligonucleotide
uugaacccucguaaacucc

SEQ ID NO: 6381 - RNA, 19 nt, Artificial Sequence
  Description of Artificial Sequence: Synthetic oligonucleotide
gaguuuacgaggguucaag

SEQ ID NO: 6382 - RNA, 19 nt, Artificial Sequence
  Description of Artificial Sequence: Synthetic oligonucleotide
cuugaacccucguaaacuc

SEQ ID NO: 6383 - RNA, 19 nt, Artificial Sequence
  Description of Artificial Sequence: Synthetic oligonucleotide
aguuuacgaggguucaagg

SEQ ID NO: 6384 - RNA, 19 nt, Artificial Sequence
  Description of Artificial Sequence: Synthetic oligonucleotide
ccuugaacccucguaaacu

SEQ ID NO: 6385 - RNA, 19 nt, Artificial Sequence
  Description of Artificial Sequence: Synthetic oligonucleotide
guuuacgaggguucaaggu

SEQ ID NO: 6386 - RNA, 19 nt, Artificial Sequence
  Description of Artificial Sequence: Synthetic oligonucleotide
accuugaacccucguaaac

SEQ ID NO: 6387 - RNA, 19 nt, Artificial Sequence
  Description of Artificial Sequence: Synthetic oligonucleotide
uuuacgaggguucaaggua

SEQ ID NO: 6388 - RNA, 19 nt, Artificial Sequence
  Description of Artificial Sequence: Synthetic oligonucleotide
uaccuugaacccucguaaa

SEQ ID NO: 6389 - RNA, 19 nt, Artificial Sequence
  Description of Artificial Sequence: Synthetic oligonucleotide
cgaggguucaagguauuug

SEQ ID NO: 6390 - RNA, 19 nt, Artificial Sequence
  Description of Artificial Sequence: Synthetic oligonucleotide
caaauaccuugaacccucg

SEQ ID NO: 6391 - RNA, 19 nt, Artificial Sequence
  Description of Artificial Sequence: Synthetic oligonucleotide
gaggguucaagguauuugg

SEQ ID NO: 6392 - RNA, 19 nt, Artificial Sequence
  Description of Artificial Sequence: Synthetic oligonucleotide
ccaaauaccuugaacccuc

SEQ ID NO: 6393 - RNA, 19 nt, Artificial Sequence
  Description of Artificial Sequence: Synthetic oligonucleotide
aggguucaagguauuuggu

SEQ ID NO: 6394 - RNA, 19 nt, Artificial Sequence
  Description of Artificial Sequence: Synthetic oligonucleotide
accaaauaccuugaacccu

SEQ ID NO: 6395 - RNA, 19 nt, Artificial Sequence
  Description of Artificial Sequence: Synthetic oligonucleotide
ggguucaagguauuugguu

SEQ ID NO: 6396 - RNA, 19 nt, Artificial Sequence
  Description of Artificial Sequence: Synthetic oligonucleotide
aaccaaauaccuugaaccc

SEQ ID NO: 6397 - RNA, 19 nt, Artificial Sequence
  Description of Artificial Sequence: Synthetic oligonucleotide
gguucaagguauuugguuc

SEQ ID NO: 6398 - RNA, 19 nt, Artificial Sequence
  Description of Artificial Sequence: Synthetic oligonucleotide
gaaccaaauaccuugaacc

SEQ ID NO: 6399 - RNA, 19 nt, Artificial Sequence
  Description of Artificial Sequence: Synthetic oligonucleotide
guucaagguauuugguuca

SEQ ID NO: 6400 - RNA, 19 nt, Artificial Sequence
  Description of Artificial Sequence: Synthetic oligonucleotide
ugaaccaaauaccuugaac

SEQ ID NO: 6401 - RNA, 19 nt, Artificial Sequence
  Description of Artificial Sequence: Synthetic oligonucleotide
uucaagguauuugguucag

SEQ ID NO: 6402 - RNA, 19 nt, Artificial Sequence
  Description of Artificial Sequence: Synthetic oligonucleotide
cugaaccaaauaccuugaa

SEQ ID NO: 6403 - RNA, 19 nt, Artificial Sequence
  Description of Artificial Sequence: Synthetic oligonucleotide
ucaagguauuugguucagg

SEQ ID NO: 6404 - RNA, 19 nt, Artificial Sequence
  Description of Artificial Sequence: Synthetic oligonucleotide
ccugaaccaaauaccuuga

SEQ ID NO: 6405 - RNA, 19 nt, Artificial Sequence
  Description of Artificial Sequence: Synthetic oligonucleotide
caacuggccaggucacagg

SEQ ID NO: 6406 - RNA, 19 nt, Artificial Sequence
  Description of Artificial Sequence: Synthetic oligonucleotide
ccugugaccuggccaguug

SEQ ID NO: 6407 - RNA, 19 nt, Artificial Sequence
  Description of Artificial Sequence: Synthetic oligonucleotide
gccaggucacagggcaauc

SEQ ID NO: 6408 - RNA, 19 nt, Artificial Sequence
  Description of Artificial Sequence: Synthetic oligonucleotide
gauugcccugugaccuggc

SEQ ID NO: 6409 - RNA, 19 nt, Artificial Sequence
  Description of Artificial Sequence: Synthetic oligonucleotide
ccaggucacagggcaauca

SEQ ID NO: 6410 - RNA, 19 nt, Artificial Sequence
  Description of Artificial Sequence: Synthetic oligonucleotide
ugauugcccugugaccugg

SEQ ID NO: 6411 - RNA, 19 nt, Artificial Sequence
  Description of Artificial Sequence: Synthetic oligonucleotide
aggucacagggcaaucaag

SEQ ID NO: 6412 - RNA, 19 nt, Artificial Sequence
  Description of Artificial Sequence: Synthetic oligonucleotide
cuugauugcccugugaccu

SEQ ID NO: 6413 - RNA, 19 nt, Artificial Sequence
  Description of Artificial Sequence: Synthetic oligonucleotide
ggucacagggcaaucaagu

SEQ ID NO: 6414 - RNA, 19 nt, Artificial Sequence
  Description of Artificial Sequence: Synthetic oligonucleotide
acuugauugcccugugacc

SEQ ID NO: 6415 - RNA, 19 nt, Artificial Sequence
  Description of Artificial Sequence: Synthetic oligonucleotide
gucacagggcaaucaaguu

SEQ ID NO: 6416 - RNA, 19 nt, Artificial Sequence
  Description of Artificial Sequence: Synthetic oligonucleotide
aacuugauugcccugugac

SEQ ID NO: 6417 - RNA, 19 nt, Artificial Sequence
  Description of Artificial Sequence: Synthetic oligonucleotide
ucacagggcaaucaaguua

SEQ ID NO: 6418 - RNA, 19 nt, Artificial Sequence
  Description of Artificial Sequence: Synthetic oligonucleotide
uaacuugauugcccuguga

SEQ ID NO: 6419 - RNA, 19 nt, Artificial Sequence
  Description of Artificial Sequence: Synthetic oligonucleotide
cacagggcaaucaaguuac

SEQ ID NO: 6420 - RNA, 19 nt, Artificial Sequence
  Description of Artificial Sequence: Synthetic oligonucleotide
guaacuugauugcccugug

SEQ ID NO: 6421 - RNA, 19 nt, Artificial Sequence
  Description of Artificial Sequence: Synthetic oligonucleotide
acagggcaaucaaguuacu

SEQ ID NO: 6422 - RNA, 19 nt, Artificial Sequence
  Description of Artificial Sequence: Synthetic oligonucleotide
aguaacuugauugcccugu

SEQ ID NO: 6423 - RNA, 19 nt, Artificial Sequence
  Description of Artificial Sequence: Synthetic oligonucleotide
cagggcaaucaaguuacuc

SEQ ID NO: 6424 - RNA, 19 nt, Artificial Sequence
  Description of Artificial Sequence: Synthetic oligonucleotide
gaguaacuugauugcccug

SEQ ID NO: 6425 - RNA, 19 nt, Artificial Sequence
  Description of Artificial Sequence: Synthetic oligonucleotide
agggcaaucaaguuacucu

SEQ ID NO: 6426 - RNA, 19 nt, Artificial Sequence
  Description of Artificial Sequence: Synthetic oligonucleotide
agaguaacuugauugcccu

SEQ ID NO: 6427 - RNA, 19 nt, Artificial Sequence
  Description of Artificial Sequence: Synthetic oligonucleotide
caaucaaguuacucugugu

SEQ ID NO: 6428 - RNA, 19 nt, Artificial Sequence
  Description of Artificial Sequence: Synthetic oligonucleotide
acacagaguaacuugauug

SEQ ID NO: 6429 - RNA, 19 nt, Artificial Sequence
  Description of Artificial Sequence: Synthetic oligonucleotide
aaucaaguuacucuguguu

SEQ ID NO: 6430 - RNA, 19 nt, Artificial Sequence
  Description of Artificial Sequence: Synthetic oligonucleotide
aacacagaguaacuugauu

SEQ ID NO: 6431 - RNA, 19 nt, Artificial Sequence
  Description of Artificial Sequence: Synthetic oligonucleotide
aucaaguuacucuguguuu

SEQ ID NO: 6432 - RNA, 19 nt, Artificial Sequence
  Description of Artificial Sequence: Synthetic oligonucleotide
aaacacagaguaacuugau

SEQ ID NO: 6433 - RNA, 19 nt, Artificial Sequence
  Description of Artificial Sequence: Synthetic oligonucleotide
acucuguguuucuuuguca

SEQ ID NO: 6434 - RNA, 19 nt, Artificial Sequence
  Description of Artificial Sequence: Synthetic oligonucleotide
ugacaaagaaacacagagu

SEQ ID NO: 6435 - RNA, 19 nt, Artificial Sequence
  Description of Artificial Sequence: Synthetic oligonucleotide
ucuguguuucuuugucagg

SEQ ID NO: 6436 - RNA, 19 nt, Artificial Sequence
  Description of Artificial Sequence: Synthetic oligonucleotide
ccugacaaagaaacacaga

SEQ ID NO: 6437 - RNA, 19 nt, Artificial Sequence
  Description of Artificial Sequence: Synthetic oligonucleotide
uguuucuuugucaggacac

SEQ ID NO: 6438 - RNA, 19 nt, Artificial Sequence
  Description of Artificial Sequence: Synthetic oligonucleotide
guguccugacaaagaaaca

SEQ ID NO: 6439 - RNA, 19 nt, Artificial Sequence
  Description of Artificial Sequence: Synthetic oligonucleotide
aaagcagggauuguguuca

SEQ ID NO: 6440 - RNA, 19 nt, Artificial Sequence
  Description of Artificial Sequence: Synthetic oligonucleotide
ugaacacaaucccugcuuu

SEQ ID NO: 6441 - RNA, 19 nt, Artificial Sequence
  Description of Artificial Sequence: Synthetic oligonucleotide
aagcagggauuguguucau

SEQ ID NO: 6442 - RNA, 19 nt, Artificial Sequence
  Description of Artificial Sequence: Synthetic oligonucleotide
augaacacaaucccugcuu

SEQ ID NO: 6443 - RNA, 19 nt, Artificial Sequence
  Description of Artificial Sequence: Synthetic oligonucleotide
agcagggauuguguucauu

SEQ ID NO: 6444 - RNA, 19 nt, Artificial Sequence
  Description of Artificial Sequence: Synthetic oligonucleotide
aaugaacacaaucccugcu

SEQ ID NO: 6445 - RNA, 19 nt, Artificial Sequence
  Description of Artificial Sequence: Synthetic oligonucleotide
gcagggauuguguucauuu

SEQ ID NO: 6446 - RNA, 19 nt, Artificial Sequence
  Description of Artificial Sequence: Synthetic oligonucleotide
aaaugaacacaaucccugc

SEQ ID NO: 6447 - RNA, 19 nt, Artificial Sequence
  Description of Artificial Sequence: Synthetic oligonucleotide
cagggauuguguucauuug

SEQ ID NO: 6448 - RNA, 19 nt, Artificial Sequence
  Description of Artificial Sequence: Synthetic oligonucleotide
caaaugaacacaaucccug

SEQ ID NO: 6449 - RNA, 19 nt, Artificial Sequence
  Description of Artificial Sequence: Synthetic oligonucleotide
agggauuguguucauuuga

SEQ ID NO: 6450 - RNA, 19 nt, Artificial Sequence
  Description of Artificial Sequence: Synthetic oligonucleotide
ucaaaugaacacaaucccu

SEQ ID NO: 6451 - RNA, 19 nt, Artificial Sequence
  Description of Artificial Sequence: Synthetic oligonucleotide
guguucauuugaggguuuc

SEQ ID NO: 6452 - RNA, 19 nt, Artificial Sequence
  Description of Artificial Sequence: Synthetic oligonucleotide
gaaacccucaaaugaacac

SEQ ID NO: 6453 - RNA, 19 nt, Artificial Sequence
  Description of Artificial Sequence: Synthetic oligonucleotide
uguucauuugaggguuuca

SEQ ID NO: 6454 - RNA, 19 nt, Artificial Sequence
  Description of Artificial Sequence: Synthetic oligonucleotide
ugaaacccucaaaugaaca

SEQ ID NO: 6455 - RNA, 19 nt, Artificial Sequence
  Description of Artificial Sequence: Synthetic oligonucleotide
guucauuugaggguuucac

SEQ ID NO: 6456 - RNA, 19 nt, Artificial Sequence
  Description of Artificial Sequence: Synthetic oligonucleotide
gugaaacccucaaaugaac

SEQ ID NO: 6457 - RNA, 19 nt, Artificial Sequence
  Description of Artificial Sequence: Synthetic oligonucleotide
uucauuugaggguuucacu

SEQ ID NO: 6458 - RNA, 19 nt, Artificial Sequence
  Description of Artificial Sequence: Synthetic oligonucleotide
agugaaacccucaaaugaa

SEQ ID NO: 6459 - RNA, 19 nt, Artificial Sequence
  Description of Artificial Sequence: Synthetic oligonucleotide
ucauuugaggguuucacug

SEQ ID NO: 6460 - RNA, 19 nt, Artificial Sequence
  Description of Artificial Sequence: Synthetic oligonucleotide
cagugaaacccucaaauga

SEQ ID NO: 6461 - RNA, 19 nt, Artificial Sequence
  Description of Artificial Sequence: Synthetic oligonucleotide
cauuugaggguuucacugu

SEQ ID NO: 6462 - RNA, 19 nt, Artificial Sequence
  Description of Artificial Sequence: Synthetic oligonucleotide
acagugaaacccucaaaug

SEQ ID NO: 6463 - RNA, 19 nt, Artificial Sequence
  Description of Artificial Sequence: Synthetic oligonucleotide
agucucagcuuccaugcaa

SEQ ID NO: 6464 - RNA, 19 nt, Artificial Sequence
  Description of Artificial Sequence: Synthetic oligonucleotide
uugcauggaagcugagacu

SEQ ID NO: 6465 - RNA, 19 nt, Artificial Sequence
  Description of Artificial Sequence: Synthetic oligonucleotide
ucucagcuuccaugcaacu

SEQ ID NO: 6466 - RNA, 19 nt, Artificial Sequence
  Description of Artificial Sequence: Synthetic oligonucleotide
aguugcauggaagcugaga

SEQ ID NO: 6467 - RNA, 19 nt, Artificial Sequence
  Description of Artificial Sequence: Synthetic oligonucleotide
cucagcuuccaugcaacug

SEQ ID NO: 6468 - RNA, 19 nt, Artificial Sequence
  Description of Artificial Sequence: Synthetic oligonucleotide
caguugcauggaagcugag

SEQ ID NO: 6469 - RNA, 19 nt, Artificial Sequence
  Description of Artificial Sequence: Synthetic oligonucleotide
ucagcuuccaugcaacugu

SEQ ID NO: 6470 - RNA, 19 nt, Artificial Sequence
  Description of Artificial Sequence: Synthetic oligonucleotide
acaguugcauggaagcuga

SEQ ID NO: 6471 - RNA, 19 nt, Artificial Sequence
  Description of Artificial Sequence: Synthetic oligonucleotide
cagcuuccaugcaacuguc

SEQ ID NO: 6472 - RNA, 19 nt, Artificial Sequence
  Description of Artificial Sequence: Synthetic oligonucleotide
gacaguugcauggaagcug

SEQ ID NO: 6473 - RNA, 19 nt, Artificial Sequence
  Description of Artificial Sequence: Synthetic oligonucleotide
agcuuccaugcaacugucc

SEQ ID NO: 6474 - RNA, 19 nt, Artificial Sequence
  Description of Artificial Sequence: Synthetic oligonucleotide
ggacaguugcauggaagcu

SEQ ID NO: 6475 - RNA, 19 nt, Artificial Sequence
  Description of Artificial Sequence: Synthetic oligonucleotide
gcuuccaugcaacugucca

SEQ ID NO: 6476 - RNA, 19 nt, Artificial Sequence
  Description of Artificial Sequence: Synthetic oligonucleotide
uggacaguugcauggaagc

SEQ ID NO: 6477 - RNA, 19 nt, Artificial Sequence
  Description of Artificial Sequence: Synthetic oligonucleotide
cuuccaugcaacuguccau

SEQ ID NO: 6478 - RNA, 19 nt, Artificial Sequence
  Description of Artificial Sequence: Synthetic oligonucleotide
auggacaguugcauggaag

SEQ ID NO: 6479 - RNA, 19 nt, Artificial Sequence
  Description of Artificial Sequence: Synthetic oligonucleotide
uuccaugcaacuguccauc

SEQ ID NO: 6480 - RNA, 19 nt, Artificial Sequence
  Description of Artificial Sequence: Synthetic oligonucleotide
gauggacaguugcauggaa

SEQ ID NO: 6481 - RNA, 19 nt, Artificial Sequence
  Description of Artificial Sequence: Synthetic oligonucleotide
ccaugcaacuguccaucac

SEQ ID NO: 6482 - RNA, 19 nt, Artificial Sequence
  Description of Artificial Sequence: Synthetic oligonucleotide
gugauggacaguugcaugg

SEQ ID NO: 6483 - RNA, 19 nt, Artificial Sequence
  Description of Artificial Sequence: Synthetic oligonucleotide
caugcaacuguccaucacg

SEQ ID NO: 6484 - RNA, 19 nt, Artificial Sequence
  Description of Artificial Sequence: Synthetic oligonucleotide
cgugauggacaguugcaug

SEQ ID NO: 6485 - RNA, 19 nt, Artificial Sequence
  Description of Artificial Sequence: Synthetic oligonucleotide
augcaacuguccaucacgg

SEQ ID NO: 6486 - RNA, 19 nt, Artificial Sequence
  Description of Artificial Sequence: Synthetic oligonucleotide
ccgugauggacaguugcau

SEQ ID NO: 6487 - RNA, 19 nt, Artificial Sequence
  Description of Artificial Sequence: Synthetic oligonucleotide
ugcaacuguccaucacggc

SEQ ID NO: 6488 - RNA, 19 nt, Artificial Sequence
  Description of Artificial Sequence: Synthetic oligonucleotide
gccgugauggacaguugca

SEQ ID NO: 6489 - RNA, 19 nt, Artificial Sequence
  Description of Artificial Sequence: Synthetic oligonucleotide
gcaacuguccaucacggcu

SEQ ID NO: 6490 - RNA, 19 nt, Artificial Sequence
  Description of Artificial Sequence: Synthetic oligonucleotide
agccgugauggacaguugc

SEQ ID NO: 6491 - RNA, 19 nt, Artificial Sequence
  Description of Artificial Sequence: Synthetic oligonucleotide
caacuguccaucacggcug

SEQ ID NO: 6492 - RNA, 19 nt, Artificial Sequence
  Description of Artificial Sequence: Synthetic oligonucleotide
cagccgugauggacaguug

SEQ ID NO: 6493 - RNA, 19 nt, Artificial Sequence
  Description of Artificial Sequence: Synthetic oligonucleotide
aacuguccaucacggcugc

SEQ ID NO: 6494 - RNA, 19 nt, Artificial Sequence
  Description of Artificial Sequence: Synthetic oligonucleotide
gcagccgugauggacaguu

SEQ ID NO: 6495 - RNA, 19 nt, Artificial Sequence
  Description of Artificial Sequence: Synthetic oligonucleotide
acuguccaucacggcugca

SEQ ID NO: 6496 - RNA, 19 nt, Artificial Sequence
  Description of Artificial Sequence: Synthetic oligonucleotide
ugcagccgugauggacagu

SEQ ID NO: 6497 - RNA, 19 nt, Artificial Sequence
  Description of Artificial Sequence: Synthetic oligonucleotide
cuguccaucacggcugcaa

SEQ ID NO: 6498 - RNA, 19 nt, Artificial Sequence
  Description of Artificial Sequence: Synthetic oligonucleotide
uugcagccgugauggacag

SEQ ID NO: 6499 - RNA, 19 nt, Artificial Sequence
  Description of Artificial Sequence: Synthetic oligonucleotide
uguccaucacggcugcaac

SEQ ID NO: 6500 - RNA, 19 nt, Artificial Sequence
  Description of Artificial Sequence: Synthetic oligonucleotide
guugcagccgugauggaca

SEQ ID NO: 6501 - RNA, 19 nt, Artificial Sequence
  Description of Artificial Sequence: Synthetic oligonucleotide
guccaucacggcugcaacu

SEQ ID NO: 6502 - RNA, 19 nt, Artificial Sequence
  Description of Artificial Sequence: Synthetic oligonucleotide
aguugcagccgugauggac

SEQ ID NO: 6503 - RNA, 19 nt, Artificial Sequence
  Description of Artificial Sequence: Synthetic oligonucleotide
uccaucacggcugcaacug

SEQ ID NO: 6504 - RNA, 19 nt, Artificial Sequence
  Description of Artificial Sequence: Synthetic oligonucleotide
caguugcagccgugaugga

SEQ ID NO: 6505 - RNA, 19 nt, Artificial Sequence
  Description of Artificial Sequence: Synthetic oligonucleotide
ccaucacggcugcaacuga

SEQ ID NO: 6506 - RNA, 19 nt, Artificial Sequence
  Description of Artificial Sequence: Synthetic oligonucleotide
ucaguugcagccgugaugg

SEQ ID NO: 6507 - RNA, 19 nt, Artificial Sequence
  Description of Artificial Sequence: Synthetic oligonucleotide
caucacggcugcaacugaa

SEQ ID NO: 6508 - RNA, 19 nt, Artificial Sequence
  Description of Artificial Sequence: Synthetic oligonucleotide
uucaguugcagccgugaug

SEQ ID NO: 6509 - RNA, 19 nt, Artificial Sequence
  Description of Artificial Sequence: Synthetic oligonucleotide
acagcgcaccagaagcuaa

SEQ ID NO: 6510 - RNA, 19 nt, Artificial Sequence
  Description of Artificial Sequence: Synthetic oligonucleotide
uuagcuucuggugcgcugu

SEQ ID NO: 6511 - RNA, 19 nt, Artificial Sequence
  Description of Artificial Sequence: Synthetic oligonucleotide
cagcgcaccagaagcuaaa

SEQ ID NO: 6512 - RNA, 19 nt, Artificial Sequence
  Description of Artificial Sequence: Synthetic oligonucleotide
uuuagcuucuggugcgcug

SEQ ID NO: 6513 - RNA, 19 nt, Artificial Sequence
  Description of Artificial Sequence: Synthetic oligonucleotide
agcgcaccagaagcuaaag

SEQ ID NO: 6514 - RNA, 19 nt, Artificial Sequence
  Description of Artificial Sequence: Synthetic oligonucleotide
cuuuagcuucuggugcgcu

SEQ ID NO: 6515 - RNA, 19 nt, Artificial Sequence
  Description of Artificial Sequence: Synthetic oligonucleotide
gcgcaccagaagcuaaagu

SEQ ID NO: 6516 - RNA, 19 nt, Artificial Sequence
  Description of Artificial Sequence: Synthetic oligonucleotide
acuuuagcuucuggugcgc

SEQ ID NO: 6517 - RNA, 19 nt, Artificial Sequence
  Description of Artificial Sequence: Synthetic oligonucleotide
cgcaccagaagcuaaaguc

SEQ ID NO: 6518 - RNA, 19 nt, Artificial Sequence
  Description of Artificial Sequence: Synthetic oligonucleotide
gacuuuagcuucuggugcg

SEQ ID NO: 6519 - RNA, 19 nt, Artificial Sequence
  Description of Artificial Sequence: Synthetic oligonucleotide
gcaccagaagcuaaagucu

SEQ ID NO: 6520 - RNA, 19 nt, Artificial Sequence
  Description of Artificial Sequence: Synthetic oligonucleotide
agacuuuagcuucuggugc

SEQ ID NO: 6521 - RNA, 19 nt, Artificial Sequence
  Description of Artificial Sequence: Synthetic oligonucleotide
caccagaagcuaaagucuu

SEQ ID NO: 6522 - RNA, 19 nt, Artificial Sequence
  Description of Artificial Sequence: Synthetic oligonucleotide
aagacuuuagcuucuggug

SEQ ID NO: 6523 - RNA, 19 nt, Artificial Sequence
  Description of Artificial Sequence: Synthetic oligonucleotide
accagaagcuaaagucuug

SEQ ID NO: 6524 - RNA, 19 nt, Artificial Sequence
  Description of Artificial Sequence: Synthetic oligonucleotide
caagacuuuagcuucuggu

SEQ ID NO: 6525 - RNA, 19 nt, Artificial Sequence
  Description of Artificial Sequence: Synthetic oligonucleotide
ccagaagcuaaagucuuga

SEQ ID NO: 6526 - RNA, 19 nt, Artificial Sequence
  Description of Artificial Sequence: Synthetic oligonucleotide
ucaagacuuuagcuucugg

SEQ ID NO: 6527 - RNA, 19 nt, Artificial Sequence
  Description of Artificial Sequence: Synthetic oligonucleotide
cagaagcuaaagucuugau

SEQ ID NO: 6528 - RNA, 19 nt, Artificial Sequence
  Description of Artificial Sequence: Synthetic oligonucleotide
aucaagacuuuagcuucug

SEQ ID NO: 6529 - RNA, 19 nt, Artificial Sequence
  Description of Artificial Sequence: Synthetic oligonucleotide
agaagcuaaagucuugaug

SEQ ID NO: 6530 - RNA, 19 nt, Artificial Sequence
  Description of Artificial Sequence: Synthetic oligonucleotide
caucaagacuuuagcuucu

SEQ ID NO: 6531 - RNA, 19 nt, Artificial Sequence
  Description of Artificial Sequence: Synthetic oligonucleotide
gaagcuaaagucuugaugc

SEQ ID NO: 6532 - RNA, 19 nt, Artificial Sequence
  Description of Artificial Sequence: Synthetic oligonucleotide
gcaucaagacuuuagcuuc

SEQ ID NO: 6533 - RNA, 19 nt, Artificial Sequence
  Description of Artificial Sequence: Synthetic oligonucleotide
aagcuaaagucuugaugcc

SEQ ID NO: 6534 - RNA, 19 nt, Artificial Sequence
  Description of Artificial Sequence: Synthetic oligonucleotide
ggcaucaagacuuuagcuu

SEQ ID NO: 6535 - RNA, 19 nt, Artificial Sequence
  Description of Artificial Sequence: Synthetic oligonucleotide
agcuaaagucuugaugcca

SEQ ID NO: 6536 - RNA, 19 nt, Artificial Sequence
  Description of Artificial Sequence: Synthetic oligonucleotide
uggcaucaagacuuuagcu

SEQ ID NO: 6537 - RNA, 19 nt, Artificial Sequence
  Description of Artificial Sequence: Synthetic oligonucleotide
cccauucacaucucuguca

SEQ ID NO: 6538 - RNA, 19 nt, Artificial Sequence
  Description of Artificial Sequence: Synthetic oligonucleotide
ugacagagaugugaauggg

SEQ ID NO: 6539 - RNA, 19 nt, Artificial Sequence
  Description of Artificial Sequence: Synthetic oligonucleotide
uucacaucucugucacguc

SEQ ID NO: 6540 - RNA, 19 nt, Artificial Sequence
  Description of Artificial Sequence: Synthetic oligonucleotide
gacgugacagagaugugaa

SEQ ID NO: 6541 - RNA, 19 nt, Artificial Sequence
  Description of Artificial Sequence: Synthetic oligonucleotide
ucacaucucugucacgucc

SEQ ID NO: 6542 - RNA, 19 nt, Artificial Sequence
  Description of Artificial Sequence: Synthetic oligonucleotide
ggacgugacagagauguga

SEQ ID NO: 6543 - RNA, 19 nt, Artificial Sequence
  Description of Artificial Sequence: Synthetic oligonucleotide
cacaucucugucacgucca

SEQ ID NO: 6544 - RNA, 19 nt, Artificial Sequence
  Description of Artificial Sequence: Synthetic oligonucleotide
uggacgugacagagaugug

SEQ ID NO: 6545 - RNA, 19 nt, Artificial Sequence
  Description of Artificial Sequence: Synthetic oligonucleotide
ucucugucacguccacuaa

SEQ ID NO: 6546 - RNA, 19 nt, Artificial Sequence
  Description of Artificial Sequence: Synthetic oligonucleotide
uuaguggacgugacagaga

SEQ ID NO: 6547 - RNA, 19 nt, Artificial Sequence
  Description of Artificial Sequence: Synthetic oligonucleotide
cucugucacguccacuaau

SEQ ID NO: 6548 - RNA, 19 nt, Artificial Sequence
  Description of Artificial Sequence: Synthetic oligonucleotide
auuaguggacgugacagag

SEQ ID NO: 6549 - RNA, 19 nt, Artificial Sequence
  Description of Artificial Sequence: Synthetic oligonucleotide
ucugucacguccacuaauc

SEQ ID NO: 6550 - RNA, 19 nt, Artificial Sequence
  Description of Artificial Sequence: Synthetic oligonucleotide
gauuaguggacgugacaga

SEQ ID NO: 6551 - RNA, 19 nt, Artificial Sequence
  Description of Artificial Sequence: Synthetic oligonucleotide
cugucacguccacuaaucg

SEQ ID NO: 6552 - RNA, 19 nt, Artificial Sequence
  Description of Artificial Sequence: Synthetic oligonucleotide
cgauuaguggacgugacag

SEQ ID NO: 6553 - RNA, 19 nt, Artificial Sequence
  Description of Artificial Sequence: Synthetic oligonucleotide
ugucacguccacuaaucgg

SEQ ID NO: 6554 - RNA, 19 nt, Artificial Sequence
  Description of Artificial Sequence: Synthetic oligonucleotide
ccgauuaguggacgugaca

SEQ ID NO: 6555 - RNA, 19 nt, Artificial Sequence
  Description of Artificial Sequence: Synthetic oligonucleotide
gucacguccacuaaucggc

SEQ ID NO: 6556 - RNA, 19 nt, Artificial Sequence
  Description of Artificial Sequence: Synthetic oligonucleotide
gccgauuaguggacgugac

SEQ ID NO: 6557 - RNA, 19 nt, Artificial Sequence
  Description of Artificial Sequence: Synthetic oligonucleotide
ucacguccacuaaucggca

SEQ ID NO: 6558 - RNA, 19 nt, Artificial Sequence
  Description of Artificial Sequence: Synthetic oligonucleotide
ugccgauuaguggacguga

SEQ ID NO: 6559 - RNA, 19 nt, Artificial Sequence
  Description of Artificial Sequence: Synthetic oligonucleotide
cacguccacuaaucggcaa

SEQ ID NO: 6560 - RNA, 19 nt, Artificial Sequence
  Description of Artificial Sequence: Synthetic oligonucleotide
uugccgauuaguggacgug

SEQ ID NO: 6561 - RNA, 19 nt, Artificial Sequence
  Description of Artificial Sequence: Synthetic oligonucleotide
acguccacuaaucggcaaa

SEQ ID NO: 6562 - RNA, 19 nt, Artificial Sequence
  Description of Artificial Sequence: Synthetic oligonucleotide
uuugccgauuaguggacgu

SEQ ID NO: 6563 - RNA, 19 nt, Artificial Sequence
  Description of Artificial Sequence: Synthetic oligonucleotide
cguccacuaaucggcaaaa

SEQ ID NO: 6564 - RNA, 19 nt, Artificial Sequence
  Description of Artificial Sequence: Synthetic oligonucleotide
uuuugccgauuaguggacg

SEQ ID NO: 6565 - RNA, 19 nt, Artificial Sequence
  Description of Artificial Sequence: Synthetic oligonucleotide
guccacuaaucggcaaaag

SEQ ID NO: 6566 - RNA, 19 nt, Artificial Sequence
  Description of Artificial Sequence: Synthetic oligonucleotide
cuuuugccgauuaguggac

SEQ ID NO: 6567 - RNA, 19 nt, Artificial Sequence
  Description of Artificial Sequence: Synthetic oligonucleotide
uccacuaaucggcaaaagg

SEQ ID NO: 6568 - RNA, 19 nt, Artificial Sequence
  Description of Artificial Sequence: Synthetic oligonucleotide
ccuuuugccgauuagugga

SEQ ID NO: 6569 - RNA, 19 nt, Artificial Sequence
  Description of Artificial Sequence: Synthetic oligonucleotide
ccacuaaucggcaaaagga

SEQ ID NO: 6570 - RNA, 19 nt, Artificial Sequence
  Description of Artificial Sequence: Synthetic oligonucleotide
uccuuuugccgauuagugg

SEQ ID NO: 6571 - RNA, 19 nt, Artificial Sequence
  Description of Artificial Sequence: Synthetic oligonucleotide
cacuaaucggcaaaaggag

SEQ ID NO: 6572 - RNA, 19 nt, Artificial Sequence
  Description of Artificial Sequence: Synthetic oligonucleotide
cuccuuuugccgauuagug

SEQ ID NO: 6573 - RNA, 19 nt, Artificial Sequence
  Description of Artificial Sequence: Synthetic oligonucleotide
agaagaugaccuaagugug

SEQ ID NO: 6574 - RNA, 19 nt, Artificial Sequence
  Description of Artificial Sequence: Synthetic oligonucleotide
cacacuuaggucaucuucu

SEQ ID NO: 6575 - RNA, 19 nt, Artificial Sequence
  Description of Artificial Sequence: Synthetic oligonucleotide
gaagaugaccuaaguguga

SEQ ID NO: 6576 - RNA, 19 nt, Artificial Sequence
  Description of Artificial Sequence: Synthetic oligonucleotide
ucacacuuaggucaucuuc

SEQ ID NO: 6577 - RNA, 19 nt, Artificial Sequence
  Description of Artificial Sequence: Synthetic oligonucleotide
aagaugaccuaagugugac

SEQ ID NO: 6578 - RNA, 19 nt, Artificial Sequence
  Description of Artificial Sequence: Synthetic oligonucleotide
gucacacuuaggucaucuu

SEQ ID NO: 6579 - RNA, 19 nt, Artificial Sequence
  Description of Artificial Sequence: Synthetic oligonucleotide
agaugaccuaagugugacu

SEQ ID NO: 6580 - RNA, 19 nt, Artificial Sequence
  Description of Artificial Sequence: Synthetic oligonucleotide
agucacacuuaggucaucu

SEQ ID NO: 6581 - RNA, 19 nt, Artificial Sequence
  Description of Artificial Sequence: Synthetic oligonucleotide
gaugaccuaagugugacug

SEQ ID NO: 6582 - RNA, 19 nt, Artificial Sequence
  Description of Artificial Sequence: Synthetic oligonucleotide
cagucacacuuaggucauc

SEQ ID NO: 6583 - RNA, 19 nt, Artificial Sequence
  Description of Artificial Sequence: Synthetic oligonucleotide
augaccuaagugugacugc

SEQ ID NO: 6584 - RNA, 19 nt, Artificial Sequence
  Description of Artificial Sequence: Synthetic oligonucleotide
gcagucacacuuaggucau

SEQ ID NO: 6585 - RNA, 19 nt, Artificial Sequence
  Description of Artificial Sequence: Synthetic oligonucleotide
ugaccuaagugugacugca

SEQ ID NO: 6586 - RNA, 19 nt, Artificial Sequence
  Description of Artificial Sequence: Synthetic oligonucleotide
ugcagucacacuuagguca

SEQ ID NO: 6587 - RNA, 19 nt, Artificial Sequence
  Description of Artificial Sequence: Synthetic oligonucleotide
aaaaugaagccagagcagu

SEQ ID NO: 6588 - RNA, 19 nt, Artificial Sequence
  Description of Artificial Sequence: Synthetic oligonucleotide
acugcucuggcuucauuuu

SEQ ID NO: 6589 - RNA, 19 nt, Artificial Sequence
  Description of Artificial Sequence: Synthetic oligonucleotide
uccgaccaaggaggaagga

SEQ ID NO: 6590 - RNA, 19 nt, Artificial Sequence
  Description of Artificial Sequence: Synthetic oligonucleotide
uccuuccuccuuggucgga

SEQ ID NO: 6591 - RNA, 19 nt, Artificial Sequence
  Description of Artificial Sequence: Synthetic oligonucleotide
ccgaccaaggaggaaggaa

SEQ ID NO: 6592 - RNA, 19 nt, Artificial Sequence
  Description of Artificial Sequence: Synthetic oligonucleotide
uuccuuccuccuuggucgg

SEQ ID NO: 6593 - RNA, 19 nt, Artificial Sequence
  Description of Artificial Sequence: Synthetic oligonucleotide
agagcagguaagcaggaag

SEQ ID NO: 6594 - RNA, 19 nt, Artificial Sequence
  Description of Artificial Sequence: Synthetic oligonucleotide
cuuccugcuuaccugcucu

SEQ ID NO: 6595 - RNA, 19 nt, Artificial Sequence
  Description of Artificial Sequence: Synthetic oligonucleotide
gagcagguaagcaggaagg

SEQ ID NO: 6596 - RNA, 19 nt, Artificial Sequence
  Description of Artificial Sequence: Synthetic oligonucleotide
ccuuccugcuuaccugcuc

SEQ ID NO: 6597 - RNA, 19 nt, Artificial Sequence
  Description of Artificial Sequence: Synthetic oligonucleotide
agguaagcaggaaggccag

SEQ ID NO: 6598 - RNA, 19 nt, Artificial Sequence
  Description of Artificial Sequence: Synthetic oligonucleotide
cuggccuuccugcuuaccu

SEQ ID NO: 6599 - RNA, 19 nt, Artificial Sequence
  Description of Artificial Sequence: Synthetic oligonucleotide
agcaggaaggccagugucc

SEQ ID NO: 6600 - RNA, 19 nt, Artificial Sequence
  Description of Artificial Sequence: Synthetic oligonucleotide
ggacacuggccuuccugcu

SEQ ID NO: 6601 - RNA, 19 nt, Artificial Sequence
  Description of Artificial Sequence: Synthetic oligonucleotide
caggaaggccaguguccca

SEQ ID NO: 6602 - RNA, 19 nt, Artificial Sequence
  Description of Artificial Sequence: Synthetic oligonucleotide
ugggacacuggccuuccug

SEQ ID NO: 6603 - RNA, 19 nt, Artificial Sequence
  Description of Artificial Sequence: Synthetic oligonucleotide
ucccagacaggacccuaau

SEQ ID NO: 6604 - RNA, 19 nt, Artificial Sequence
  Description of Artificial Sequence: Synthetic oligonucleotide
auuaggguccugucuggga

SEQ ID NO: 6605 - RNA, 19 nt, Artificial Sequence
  Description of Artificial Sequence: Synthetic oligonucleotide
cccagacaggacccuaaug

SEQ ID NO: 6606 - RNA, 19 nt, Artificial Sequence
  Description of Artificial Sequence: Synthetic oligonucleotide
cauuaggguccugucuggg

SEQ ID NO: 6607 - RNA, 19 nt, Artificial Sequence
  Description of Artificial Sequence: Synthetic oligonucleotide
ccagacaggacccuaauga

SEQ ID NO: 6608 - RNA, 19 nt, Artificial Sequence
  Description of Artificial Sequence: Synthetic oligonucleotide
ucauuaggguccugucugg

SEQ ID NO: 6609 - RNA, 19 nt, Artificial Sequence
  Description of Artificial Sequence: Synthetic oligonucleotide
cagacaggacccuaaugau

SEQ ID NO: 6610 - RNA, 19 nt, Artificial Sequence
  Description of Artificial Sequence: Synthetic oligonucleotide
aucauuaggguccugucug

SEQ ID NO: 6611 - RNA, 19 nt, Artificial Sequence
  Description of Artificial Sequence: Synthetic oligonucleotide
agacaggacccuaaugauc

SEQ ID NO: 6612 - RNA, 19 nt, Artificial Sequence
  Description of Artificial Sequence: Synthetic oligonucleotide
gaucauuaggguccugucu

SEQ ID NO: 6613 - RNA, 19 nt, Artificial Sequence
  Description of Artificial Sequence: Synthetic oligonucleotide
gacaggacccuaaugaucc

SEQ ID NO: 6614 - RNA, 19 nt, Artificial Sequence
  Description of Artificial Sequence: Synthetic oligonucleotide
ggaucauuaggguccuguc

SEQ ID NO: 6615 - RNA, 19 nt, Artificial Sequence
  Description of Artificial Sequence: Synthetic oligonucleotide
ggacccuaaugauccugaa

SEQ ID NO: 6616 - RNA, 19 nt, Artificial Sequence
  Description of Artificial Sequence: Synthetic oligonucleotide
uucaggaucauuagggucc

SEQ ID NO: 6617 - RNA, 19 nt, Artificial Sequence
  Description of Artificial Sequence: Synthetic oligonucleotide
ccuaaugauccugaaucca

SEQ ID NO: 6618 - RNA, 19 nt, Artificial Sequence
  Description of Artificial Sequence: Synthetic oligonucleotide
uggauucaggaucauuagg

SEQ ID NO: 6619 - RNA, 19 nt, Artificial Sequence
  Description of Artificial Sequence: Synthetic oligonucleotide
cuaaugauccugaauccau

SEQ ID NO: 6620 - RNA, 19 nt, Artificial Sequence
  Description of Artificial Sequence: Synthetic oligonucleotide
auggauucaggaucauuag

SEQ ID NO: 6621 - RNA, 19 nt, Artificial Sequence
  Description of Artificial Sequence: Synthetic oligonucleotide
ugauccugaauccauguau

SEQ ID NO: 6622 - RNA, 19 nt, Artificial Sequence
  Description of Artificial Sequence: Synthetic oligonucleotide
auacauggauucaggauca

SEQ ID NO: 6623 - RNA, 19 nt, Artificial Sequence
  Description of Artificial Sequence: Synthetic oligonucleotide
gauccugaauccauguauc

SEQ ID NO: 6624 - RNA, 19 nt, Artificial Sequence
  Description of Artificial Sequence: Synthetic oligonucleotide
gauacauggauucaggauc

SEQ ID NO: 6625 - RNA, 19 nt, Artificial Sequence
  Description of Artificial Sequence: Synthetic oligonucleotide
auccugaauccauguauca

SEQ ID NO: 6626 - RNA, 19 nt, Artificial Sequence
  Description of Artificial Sequence: Synthetic oligonucleotide
ugauacauggauucaggau

SEQ ID NO: 6627 - RNA, 19 nt, Artificial Sequence
  Description of Artificial Sequence: Synthetic oligonucleotide
uccauguaucaggauccau

SEQ ID NO: 6628 - RNA, 19 nt, Artificial Sequence
  Description of Artificial Sequence: Synthetic oligonucleotide
auggauccugauacaugga

SEQ ID NO: 6629 - RNA, 19 nt, Artificial Sequence
  Description of Artificial Sequence: Synthetic oligonucleotide
ccauguaucaggauccauc

SEQ ID NO: 6630 - RNA, 19 nt, Artificial Sequence
  Description of Artificial Sequence: Synthetic oligonucleotide
gauggauccugauacaugg

SEQ ID NO: 6631 - RNA, 19 nt, Artificial Sequence
  Description of Artificial Sequence: Synthetic oligonucleotide
cauguaucaggauccaucc

SEQ ID NO: 6632 - RNA, 19 nt, Artificial Sequence
  Description of Artificial Sequence: Synthetic oligonucleotide
ggauggauccugauacaug

SEQ ID NO: 6633 - RNA, 19 nt, Artificial Sequence
  Description of Artificial Sequence: Synthetic oligonucleotide
ucaccucucauuuuccaaa

SEQ ID NO: 6634 - RNA, 19 nt, Artificial Sequence
  Description of Artificial Sequence: Synthetic oligonucleotide
uuuggaaaaugagagguga

SEQ ID NO: 6635 - RNA, 19 nt, Artificial Sequence
  Description of Artificial Sequence: Synthetic oligonucleotide
uccaaagcccugccaugcu

SEQ ID NO: 6636 - RNA, 19 nt, Artificial Sequence
  Description of Artificial Sequence: Synthetic oligonucleotide
agcauggcagggcuuugga

SEQ ID NO: 6637 - RNA, 19 nt, Artificial Sequence
  Description of Artificial Sequence: Synthetic oligonucleotide
ccaaagcccugccaugcug

SEQ ID NO: 6638 - RNA, 19 nt, Artificial Sequence
  Description of Artificial Sequence: Synthetic oligonucleotide
cagcauggcagggcuuugg

SEQ ID NO: 6639 - RNA, 19 nt, Artificial Sequence
  Description of Artificial Sequence: Synthetic oligonucleotide
caugcugccaucccacuuc

SEQ ID NO: 6640 - RNA, 19 nt, Artificial Sequence
  Description of Artificial Sequence: Synthetic oligonucleotide
gaagugggauggcagcaug

SEQ ID NO: 6641 - RNA, 19 nt, Artificial Sequence
  Description of Artificial Sequence: Synthetic oligonucleotide
augcugccaucccacuucc

SEQ ID NO: 6642 - RNA, 19 nt, Artificial Sequence
  Description of Artificial Sequence: Synthetic oligonucleotide
ggaagugggauggcagcau

SEQ ID NO: 6643 - RNA, 19 nt, Artificial Sequence
  Description of Artificial Sequence: Synthetic oligonucleotide
ugcugccaucccacuuccc

SEQ ID NO: 6644 - RNA, 19 nt, Artificial Sequence
  Description of Artificial Sequence: Synthetic oligonucleotide
gggaagugggauggcagca

SEQ ID NO: 6645 - RNA, 19 nt, Artificial Sequence
  Description of Artificial Sequence: Synthetic oligonucleotide
cggguucccuuuuccuaaa

SEQ ID NO: 6646 - RNA, 19 nt, Artificial Sequence
  Description of Artificial Sequence: Synthetic oligonucleotide
uuuaggaaaagggaacccg

SEQ ID NO: 6647 - RNA, 19 nt, Artificial Sequence
  Description of Artificial Sequence: Synthetic oligonucleotide
agcugcagcuuauggcuuc

SEQ ID NO: 6648 - RNA, 19 nt, Artificial Sequence
  Description of Artificial Sequence: Synthetic oligonucleotide
gaagccauaagcugcagcu

SEQ ID NO: 6649 - RNA, 19 nt, Artificial Sequence
  Description of Artificial Sequence: Synthetic oligonucleotide
gcugcagcuuauggcuucu

SEQ ID NO: 6650 - RNA, 19 nt, Artificial Sequence
  Description of Artificial Sequence: Synthetic oligonucleotide
agaagccauaagcugcagc

SEQ ID NO: 6651 - RNA, 19 nt, Artificial Sequence
  Description of Artificial Sequence: Synthetic oligonucleotide
cugcagcuuauggcuucuc

SEQ ID NO: 6652 - RNA, 19 nt, Artificial Sequence
  Description of Artificial Sequence: Synthetic oligonucleotide
gagaagccauaagcugcag

SEQ ID NO: 6653 - RNA, 19 nt, Artificial Sequence
  Description of Artificial Sequence: Synthetic oligonucleotide
ugcagcuuauggcuucucc

SEQ ID NO: 6654 - RNA, 19 nt, Artificial Sequence
  Description of Artificial Sequence: Synthetic oligonucleotide
ggagaagccauaagcugca

SEQ ID NO: 6655 - RNA, 19 nt, Artificial Sequence
  Description of Artificial Sequence: Synthetic oligonucleotide
gcagcuuauggcuucucca

SEQ ID NO: 6656 - RNA, 19 nt, Artificial Sequence
  Description of Artificial Sequence: Synthetic oligonucleotide
uggagaagccauaagcugc

SEQ ID NO: 6657 - RNA, 19 nt, Artificial Sequence
  Description of Artificial Sequence: Synthetic oligonucleotide
cagcuuauggcuucuccag

SEQ ID NO: 6658 - RNA, 19 nt, Artificial Sequence
  Description of Artificial Sequence: Synthetic oligonucleotide
cuggagaagccauaagcug

SEQ ID NO: 6659 - RNA, 19 nt, Artificial Sequence
  Description of Artificial Sequence: Synthetic oligonucleotide
agcuuauggcuucuccagu

SEQ ID NO: 6660 - RNA, 19 nt, Artificial Sequence
  Description of Artificial Sequence: Synthetic oligonucleotide
acuggagaagccauaagcu

SEQ ID NO: 6661 - RNA, 19 nt, Artificial Sequence
  Description of Artificial Sequence: Synthetic oligonucleotide
gcuuauggcuucuccagua

SEQ ID NO: 6662 - RNA, 19 nt, Artificial Sequence
  Description of Artificial Sequence: Synthetic oligonucleotide
uacuggagaagccauaagc

SEQ ID NO: 6663 - RNA, 19 nt, Artificial Sequence
  Description of Artificial Sequence: Synthetic oligonucleotide
cuuauggcuucuccaguag

SEQ ID NO: 6664 - RNA, 19 nt, Artificial Sequence
  Description of Artificial Sequence: Synthetic oligonucleotide
cuacuggagaagccauaag

SEQ ID NO: 6665 - RNA, 19 nt, Artificial Sequence
  Description of Artificial Sequence: Synthetic oligonucleotide
uuauggcuucuccaguagg

SEQ ID NO: 6666 - RNA, 19 nt, Artificial Sequence
  Description of Artificial Sequence: Synthetic oligonucleotide
ccuacuggagaagccauaa

SEQ ID NO: 6667 - RNA, 19 nt, Artificial Sequence
  Description of Artificial Sequence: Synthetic oligonucleotide
uauggcuucuccaguaggu

SEQ ID NO: 6668 - RNA, 19 nt, Artificial Sequence
  Description of Artificial Sequence: Synthetic oligonucleotide
accuacuggagaagccaua

SEQ ID NO: 6669 - RNA, 19 nt, Artificial Sequence
  Description of Artificial Sequence: Synthetic oligonucleotide
auggcuucuccaguaggug

SEQ ID NO: 6670 - RNA, 19 nt, Artificial Sequence
  Description of Artificial Sequence: Synthetic oligonucleotide
caccuacuggagaagccau

SEQ ID NO: 6671 - RNA, 19 nt, Artificial Sequence
  Description of Artificial Sequence: Synthetic oligonucleotide
uggcuucuccaguaggugg

SEQ ID NO: 6672 - RNA, 19 nt, Artificial Sequence
  Description of Artificial Sequence: Synthetic oligonucleotide
ccaccuacuggagaagcca

SEQ ID NO: 6673 - RNA, 19 nt, Artificial Sequence
  Description of Artificial Sequence: Synthetic oligonucleotide
ggcuucuccaguagguggc

SEQ ID NO: 6674 - RNA, 19 nt, Artificial Sequence
  Description of Artificial Sequence: Synthetic oligonucleotide
gccaccuacuggagaagcc

SEQ ID NO: 6675 - RNA, 19 nt, Artificial Sequence
  Description of Artificial Sequence: Synthetic oligonucleotide
gcuucuccaguagguggca

SEQ ID NO: 6676 - RNA, 19 nt, Artificial Sequence
  Description of Artificial Sequence: Synthetic oligonucleotide
ugccaccuacuggagaagc

SEQ ID NO: 6677 - RNA, 19 nt, Artificial Sequence
  Description of Artificial Sequence: Synthetic oligonucleotide
cuucuccaguagguggcag

SEQ ID NO: 6678 - RNA, 19 nt, Artificial Sequence
  Description of Artificial Sequence: Synthetic oligonucleotide
cugccaccuacuggagaag

SEQ ID NO: 6679 - RNA, 19 nt, Artificial Sequence
  Description of Artificial Sequence: Synthetic oligonucleotide
uucuccaguagguggcagc

SEQ ID NO: 6680 - RNA, 19 nt, Artificial Sequence
  Description of Artificial Sequence: Synthetic oligonucleotide
gcugccaccuacuggagaa

SEQ ID NO: 6681 - RNA, 19 nt, Artificial Sequence
  Description of Artificial Sequence: Synthetic oligonucleotide
ucuccaguagguggcagca

SEQ ID NO: 6682 - RNA, 19 nt, Artificial Sequence
  Description of Artificial Sequence: Synthetic oligonucleotide
ugcugccaccuacuggaga

SEQ ID NO: 6683 - RNA, 19 nt, Artificial Sequence
  Description of Artificial Sequence: Synthetic oligonucleotide
cuccaguagguggcagcac

SEQ ID NO: 6684 - RNA, 19 nt, Artificial Sequence
  Description of Artificial Sequence: Synthetic oligonucleotide
gugcugccaccuacuggag

SEQ ID NO: 6685 - RNA, 19 nt, Artificial Sequence
  Description of Artificial Sequence: Synthetic oligonucleotide
acaccagaagucacauuuc

SEQ ID NO: 6686 - RNA, 19 nt, Artificial Sequence
  Description of Artificial Sequence: Synthetic oligonucleotide
gaaaugugacuucuggugu

SEQ ID NO: 6687 - RNA, 19 nt, Artificial Sequence
  Description of Artificial Sequence: Synthetic oligonucleotide
gaagucacauuucauccuu

SEQ ID NO: 6688 - RNA, 19 nt, Artificial Sequence
  Description of Artificial Sequence: Synthetic oligonucleotide
aaggaugaaaugugacuuc

SEQ ID NO: 6689 - RNA, 19 nt, Artificial Sequence
  Description of Artificial Sequence: Synthetic oligonucleotide
aagucacauuucauccuuu

SEQ ID NO: 6690 - RNA, 19 nt, Artificial Sequence
  Description of Artificial Sequence: Synthetic oligonucleotide
aaaggaugaaaugugacuu

SEQ ID NO: 6691 - RNA, 19 nt, Artificial Sequence
  Description of Artificial Sequence: Synthetic oligonucleotide
agucacauuucauccuuuu

SEQ ID NO: 6692 - RNA, 19 nt, Artificial Sequence
  Description of Artificial Sequence: Synthetic oligonucleotide
aaaaggaugaaaugugacu

SEQ ID NO: 6693 - RNA, 19 nt, Artificial Sequence
  Description of Artificial Sequence: Synthetic oligonucleotide
uuucauccuuuuacauggu

SEQ ID NO: 6694 - RNA, 19 nt, Artificial Sequence
  Description of Artificial Sequence: Synthetic oligonucleotide
accauguaaaaggaugaaa

SEQ ID NO: 6695 - RNA, 19 nt, Artificial Sequence
  Description of Artificial Sequence: Synthetic oligonucleotide
uucauccuuuuacaugguu

SEQ ID NO: 6696 - RNA, 19 nt, Artificial Sequence
  Description of Artificial Sequence: Synthetic oligonucleotide
aaccauguaaaaggaugaa

SEQ ID NO: 6697 - RNA, 19 nt, Artificial Sequence
  Description of Artificial Sequence: Synthetic oligonucleotide
ucauccuuuuacaugguuc

SEQ ID NO: 6698 - RNA, 19 nt, Artificial Sequence
  Description of Artificial Sequence: Synthetic oligonucleotide
gaaccauguaaaaggauga

SEQ ID NO: 6699 - RNA, 19 nt, Artificial Sequence
  Description of Artificial Sequence: Synthetic oligonucleotide
cauccuuuuacaugguucc

SEQ ID NO: 6700 - RNA, 19 nt, Artificial Sequence
  Description of Artificial Sequence: Synthetic oligonucleotide
ggaaccauguaaaaggaug

SEQ ID NO: 6701 - RNA, 19 nt, Artificial Sequence
  Description of Artificial Sequence: Synthetic oligonucleotide
ugguucccaucuacccuca

SEQ ID NO: 6702 - RNA, 19 nt, Artificial Sequence
  Description of Artificial Sequence: Synthetic oligonucleotide
ugaggguagaugggaacca

SEQ ID NO: 6703 - RNA, 19 nt, Artificial Sequence
  Description of Artificial Sequence: Synthetic oligonucleotide
gguucccaucuacccucac

SEQ ID NO: 6704 - RNA, 19 nt, Artificial Sequence
  Description of Artificial Sequence: Synthetic oligonucleotide
gugaggguagaugggaacc

SEQ ID NO: 6705 - RNA, 19 nt, Artificial Sequence
  Description of Artificial Sequence: Synthetic oligonucleotide
guucccaucuacccucaca

SEQ ID NO: 6706 - RNA, 19 nt, Artificial Sequence
  Description of Artificial Sequence: Synthetic oligonucleotide
ugugaggguagaugggaac

SEQ ID NO: 6707 - RNA, 19 nt, Artificial Sequence
  Description of Artificial Sequence: Synthetic oligonucleotide
ggcaauucuuccuccagga

SEQ ID NO: 6708 - RNA, 19 nt, Artificial Sequence
  Description of Artificial Sequence: Synthetic oligonucleotide
uccuggaggaagaauugcc

SEQ ID NO: 6709 - RNA, 19 nt, Artificial Sequence
  Description of Artificial Sequence: Synthetic oligonucleotide
gcaauucuuccuccaggac

SEQ ID NO: 6710 - RNA, 19 nt, Artificial Sequence
  Description of Artificial Sequence: Synthetic oligonucleotide
guccuggaggaagaauugc

SEQ ID NO: 6711 - RNA, 19 nt, Artificial Sequence
  Description of Artificial Sequence: Synthetic oligonucleotide
caauucuuccuccaggacc

SEQ ID NO: 6712 - RNA, 19 nt, Artificial Sequence
  Description of Artificial Sequence: Synthetic oligonucleotide
gguccuggaggaagaauug

SEQ ID NO: 6713 - RNA, 19 nt, Artificial Sequence
  Description of Artificial Sequence: Synthetic oligonucleotide
aauucuuccuccaggaccc

SEQ ID NO: 6714 - RNA, 19 nt, Artificial Sequence
  Description of Artificial Sequence: Synthetic oligonucleotide
ggguccuggaggaagaauu

SEQ ID NO: 6715 - RNA, 19 nt, Artificial Sequence
  Description of Artificial Sequence: Synthetic oligonucleotide
cccuuggacuuugcccuuc

SEQ ID NO: 6716 - RNA, 19 nt, Artificial Sequence
  Description of Artificial Sequence: Synthetic oligonucleotide
gaagggcaaaguccaaggg

SEQ ID NO: 6717 - RNA, 19 nt, Artificial Sequence
  Description of Artificial Sequence: Synthetic oligonucleotide
ccuuggacuuugcccuucu

SEQ ID NO: 6718 - RNA, 19 nt, Artificial Sequence
  Description of Artificial Sequence: Synthetic oligonucleotide
agaagggcaaaguccaagg

SEQ ID NO: 6719 - RNA, 19 nt, Artificial Sequence
  Description of Artificial Sequence: Synthetic oligonucleotide
cuuggacuuugcccuucuu

SEQ ID NO: 6720 - RNA, 19 nt, Artificial Sequence
  Description of Artificial Sequence: Synthetic oligonucleotide
aagaagggcaaaguccaag

SEQ ID NO: 6721 - RNA, 19 nt, Artificial Sequence
  Description of Artificial Sequence: Synthetic oligonucleotide
uuggacuuugcccuucuua

SEQ ID NO: 6722 - RNA, 19 nt, Artificial Sequence
  Description of Artificial Sequence: Synthetic oligonucleotide
uaagaagggcaaaguccaa

SEQ ID NO: 6723 - RNA, 19 nt, Artificial Sequence
  Description of Artificial Sequence: Synthetic oligonucleotide
uggacuuugcccuucuuac

SEQ ID NO: 6724 - RNA, 19 nt, Artificial Sequence
  Description of Artificial Sequence: Synthetic oligonucleotide
guaagaagggcaaagucca

SEQ ID NO: 6725 - RNA, 19 nt, Artificial Sequence
  Description of Artificial Sequence: Synthetic oligonucleotide
ggacuuugcccuucuuacu

SEQ ID NO: 6726 - RNA, 19 nt, Artificial Sequence
  Description of Artificial Sequence: Synthetic oligonucleotide
aguaagaagggcaaagucc

SEQ ID NO: 6727 - RNA, 19 nt, Artificial Sequence
  Description of Artificial Sequence: Synthetic oligonucleotide
uuugcccuucuuacuggcc

SEQ ID NO: 6728 - RNA, 19 nt, Artificial Sequence
  Description of Artificial Sequence: Synthetic oligonucleotide
ggccaguaagaagggcaaa

SEQ ID NO: 6729 - RNA, 19 nt, Artificial Sequence
  Description of Artificial Sequence: Synthetic oligonucleotide
uugcccuucuuacuggcca

SEQ ID NO: 6730 - RNA, 19 nt, Artificial Sequence
  Description of Artificial Sequence: Synthetic oligonucleotide
uggccaguaagaagggcaa

SEQ ID NO: 6731 - RNA, 19 nt, Artificial Sequence
  Description of Artificial Sequence: Synthetic oligonucleotide
ugcccuucuuacuggccag

SEQ ID NO: 6732 - RNA, 19 nt, Artificial Sequence
  Description of Artificial Sequence: Synthetic oligonucleotide
cuggccaguaagaagggca

SEQ ID NO: 6733 - RNA, 19 nt, Artificial Sequence
  Description of Artificial Sequence: Synthetic oligonucleotide
ucuuacuggccaggcaggg

SEQ ID NO: 6734 - RNA, 19 nt, Artificial Sequence
  Description of Artificial Sequence: Synthetic oligonucleotide
cccugccuggccaguaaga

SEQ ID NO: 6735 - RNA, 19 nt, Artificial Sequence
  Description of Artificial Sequence: Synthetic oligonucleotide
ggccagaguccaggcuuga

SEQ ID NO: 6736 - RNA, 19 nt, Artificial Sequence
  Description of Artificial Sequence: Synthetic oligonucleotide
ucaagccuggacucuggcc

SEQ ID NO: 6737 - RNA, 19 nt, Artificial Sequence
  Description of Artificial Sequence: Synthetic oligonucleotide
gccagaguccaggcuugac

SEQ ID NO: 6738 - RNA, 19 nt, Artificial Sequence
  Description of Artificial Sequence: Synthetic oligonucleotide
gucaagccuggacucuggc

SEQ ID NO: 6739 - RNA, 19 nt, Artificial Sequence
  Description of Artificial Sequence: Synthetic oligonucleotide
guccaggcuugacucauuc

SEQ ID NO: 6740 - RNA, 19 nt, Artificial Sequence
  Description of Artificial Sequence: Synthetic oligonucleotide
gaaugagucaagccuggac

SEQ ID NO: 6741 - RNA, 19 nt, Artificial Sequence
  Description of Artificial Sequence: Synthetic oligonucleotide
aggcuugacucauucccac

SEQ ID NO: 6742 - RNA, 19 nt, Artificial Sequence
  Description of Artificial Sequence: Synthetic oligonucleotide
gugggaaugagucaagccu

SEQ ID NO: 6743 - RNA, 19 nt, Artificial Sequence
  Description of Artificial Sequence: Synthetic oligonucleotide
gacucauucccaccuuguc

SEQ ID NO: 6744 - RNA, 19 nt, Artificial Sequence
  Description of Artificial Sequence: Synthetic oligonucleotide
gacaaggugggaaugaguc

SEQ ID NO: 6745 - RNA, 19 nt, Artificial Sequence
  Description of Artificial Sequence: Synthetic oligonucleotide
acucauucccaccuugucc

SEQ ID NO: 6746 - RNA, 19 nt, Artificial Sequence
  Description of Artificial Sequence: Synthetic oligonucleotide
ggacaaggugggaaugagu

SEQ ID NO: 6747 - RNA, 19 nt, Artificial Sequence
  Description of Artificial Sequence: Synthetic oligonucleotide
ucauucccaccuuguccug

SEQ ID NO: 6748 - RNA, 19 nt, Artificial Sequence
  Description of Artificial Sequence: Synthetic oligonucleotide
caggacaaggugggaauga

SEQ ID NO: 6749 - RNA, 19 nt, Artificial Sequence
  Description of Artificial Sequence: Synthetic oligonucleotide
caccuuguccugggcugag

SEQ ID NO: 6750 - RNA, 19 nt, Artificial Sequence
  Description of Artificial Sequence: Synthetic oligonucleotide
cucagcccaggacaaggug

SEQ ID NO: 6751 - RNA, 19 nt, Artificial Sequence
  Description of Artificial Sequence: Synthetic oligonucleotide
accacccagcccagaaguu

SEQ ID NO: 6752 - RNA, 19 nt, Artificial Sequence
  Description of Artificial Sequence: Synthetic oligonucleotide
aacuucugggcuggguggu

SEQ ID NO: 6753 - RNA, 19 nt, Artificial Sequence
  Description of Artificial Sequence: Synthetic oligonucleotide
ccacccagcccagaaguuc

SEQ ID NO: 6754 - RNA, 19 nt, Artificial Sequence
  Description of Artificial Sequence: Synthetic oligonucleotide
gaacuucugggcugggugg

SEQ ID NO: 6755 - RNA, 19 nt, Artificial Sequence
  Description of Artificial Sequence: Synthetic oligonucleotide
cacccagcccagaaguucc

SEQ ID NO: 6756 - RNA, 19 nt, Artificial Sequence
  Description of Artificial Sequence: Synthetic oligonucleotide
ggaacuucugggcugggug

SEQ ID NO: 6757 - RNA, 19 nt, Artificial Sequence
  Description of Artificial Sequence: Synthetic oligonucleotide
acccagcccagaaguucca

SEQ ID NO: 6758 - RNA, 19 nt, Artificial Sequence
  Description of Artificial Sequence: Synthetic oligonucleotide
uggaacuucugggcugggu

SEQ ID NO: 6759 - RNA, 19 nt, Artificial Sequence
  Description of Artificial Sequence: Synthetic oligonucleotide
ccagaaguuccagggaagg

SEQ ID NO: 6760 - RNA, 19 nt, Artificial Sequence
  Description of Artificial Sequence: Synthetic oligonucleotide
ccuucccuggaacuucugg

SEQ ID NO: 6761 - RNA, 19 nt, Artificial Sequence
  Description of Artificial Sequence: Synthetic oligonucleotide
cagaaguuccagggaagga

SEQ ID NO: 6762 - RNA, 19 nt, Artificial Sequence
  Description of Artificial Sequence: Synthetic oligonucleotide
uccuucccuggaacuucug

SEQ ID NO: 6763 - RNA, 19 nt, Artificial Sequence
  Description of Artificial Sequence: Synthetic oligonucleotide
aacucuccgguccaccaug

SEQ ID NO: 6764 - RNA, 19 nt, Artificial Sequence
  Description of Artificial Sequence: Synthetic oligonucleotide
caugguggaccggagaguu

SEQ ID NO: 6765 - RNA, 19 nt, Artificial Sequence
  Description of Artificial Sequence: Synthetic oligonucleotide
acucuccgguccaccaugg

SEQ ID NO: 6766 - RNA, 19 nt, Artificial Sequence
  Description of Artificial Sequence: Synthetic oligonucleotide
ccaugguggaccggagagu

SEQ ID NO: 6767 - RNA, 19 nt, Artificial Sequence
  Description of Artificial Sequence: Synthetic oligonucleotide
caccauggaguaccucuca

SEQ ID NO: 6768 - RNA, 19 nt, Artificial Sequence
  Description of Artificial Sequence: Synthetic oligonucleotide
ugagagguacuccauggug

SEQ ID NO: 6769 - RNA, 19 nt, Artificial Sequence
  Description of Artificial Sequence: Synthetic oligonucleotide
accauggaguaccucucag

SEQ ID NO: 6770 - RNA, 19 nt, Artificial Sequence
  Description of Artificial Sequence: Synthetic oligonucleotide
cugagagguacuccauggu

SEQ ID NO: 6771 - RNA, 19 nt, Artificial Sequence
  Description of Artificial Sequence: Synthetic oligonucleotide
uggaguaccucucagcucu

SEQ ID NO: 6772 - RNA, 19 nt, Artificial Sequence
  Description of Artificial Sequence: Synthetic oligonucleotide
agagcugagagguacucca

SEQ ID NO: 6773 - RNA, 19 nt, Artificial Sequence
  Description of Artificial Sequence: Synthetic oligonucleotide
ggaguaccucucagcucug

SEQ ID NO: 6774 - RNA, 19 nt, Artificial Sequence
  Description of Artificial Sequence: Synthetic oligonucleotide
cagagcugagagguacucc

SEQ ID NO: 6775 - RNA, 19 nt, Artificial Sequence
  Description of Artificial Sequence: Synthetic oligonucleotide
gaguaccucucagcucuga

SEQ ID NO: 6776 - RNA, 19 nt, Artificial Sequence
  Description of Artificial Sequence: Synthetic oligonucleotide
ucagagcugagagguacuc

SEQ ID NO: 6777 - RNA, 19 nt, Artificial Sequence
  Description of Artificial Sequence: Synthetic oligonucleotide
aguaccucucagcucugaa

SEQ ID NO: 6778 - RNA, 19 nt, Artificial Sequence
  Description of Artificial Sequence: Synthetic oligonucleotide
uucagagcugagagguacu

SEQ ID NO: 6779 - RNA, 19 nt, Artificial Sequence
  Description of Artificial Sequence: Synthetic oligonucleotide
ccagugacuuacucaggug

SEQ ID NO: 6780 - RNA, 19 nt, Artificial Sequence
  Description of Artificial Sequence: Synthetic oligonucleotide
caccugaguaagucacugg

SEQ ID NO: 6781 - RNA, 19 nt, Artificial Sequence
  Description of Artificial Sequence: Synthetic oligonucleotide
cagugacuuacucagguga

SEQ ID NO: 6782 - RNA, 19 nt, Artificial Sequence
  Description of Artificial Sequence: Synthetic oligonucleotide
ucaccugaguaagucacug

SEQ ID NO: 6783 - RNA, 19 nt, Artificial Sequence
  Description of Artificial Sequence: Synthetic oligonucleotide
agugacuuacucaggugac

SEQ ID NO: 6784 - RNA, 19 nt, Artificial Sequence
  Description of Artificial Sequence: Synthetic oligonucleotide
gucaccugaguaagucacu

SEQ ID NO: 6785 - RNA, 19 nt, Artificial Sequence
  Description of Artificial Sequence: Synthetic oligonucleotide
gugacuuacucaggugacu

SEQ ID NO: 6786 - RNA, 19 nt, Artificial Sequence
  Description of Artificial Sequence: Synthetic oligonucleotide
agucaccugaguaagucac

SEQ ID NO: 6787 - RNA, 19 nt, Artificial Sequence
  Description of Artificial Sequence: Synthetic oligonucleotide
ugacuuacucaggugacug

SEQ ID NO: 6788 - RNA, 19 nt, Artificial Sequence
  Description of Artificial Sequence: Synthetic oligonucleotide
cagucaccugaguaaguca

SEQ ID NO: 6789 - RNA, 19 nt, Artificial Sequence
  Description of Artificial Sequence: Synthetic oligonucleotide
gacuuacucaggugacugc

SEQ ID NO: 6790 - RNA, 19 nt, Artificial Sequence
  Description of Artificial Sequence: Synthetic oligonucleotide
gcagucaccugaguaaguc

SEQ ID NO: 6791 - RNA, 19 nt, Artificial Sequence
  Description of Artificial Sequence: Synthetic oligonucleotide
acuuacucaggugacugcu

SEQ ID NO: 6792 - RNA, 19 nt, Artificial Sequence
  Description of Artificial Sequence: Synthetic oligonucleotide
agcagucaccugaguaagu

SEQ ID NO: 6793 - RNA, 19 nt, Artificial Sequence
  Description of Artificial Sequence: Synthetic oligonucleotide
cuuacucaggugacugcua

SEQ ID NO: 6794 - RNA, 19 nt, Artificial Sequence
  Description of Artificial Sequence: Synthetic oligonucleotide
uagcagucaccugaguaag

SEQ ID NO: 6795 - RNA, 19 nt, Artificial Sequence
  Description of Artificial Sequence: Synthetic oligonucleotide
uuacucaggugacugcuaa

SEQ ID NO: 6796 - RNA, 19 nt, Artificial Sequence
  Description of Artificial Sequence: Synthetic oligonucleotide
uuagcagucaccugaguaa

SEQ ID NO: 6797 - RNA, 19 nt, Artificial Sequence
  Description of Artificial Sequence: Synthetic oligonucleotide
uacucaggugacugcuaac

SEQ ID NO: 6798 - RNA, 19 nt, Artificial Sequence
  Description of Artificial Sequence: Synthetic oligonucleotide
guuagcagucaccugagua

SEQ ID NO: 6799 - RNA, 19 nt, Artificial Sequence
  Description of Artificial Sequence: Synthetic oligonucleotide
acucaggugacugcuaacc

SEQ ID NO: 6800 - RNA, 19 nt, Artificial Sequence
  Description of Artificial Sequence: Synthetic oligonucleotide
gguuagcagucaccugagu

SEQ ID NO: 6801 - RNA, 19 nt, Artificial Sequence
  Description of Artificial Sequence: Synthetic oligonucleotide
cucaggugacugcuaaccc

SEQ ID NO: 6802 - RNA, 19 nt, Artificial Sequence
  Description of Artificial Sequence: Synthetic oligonucleotide
ggguuagcagucaccugag

SEQ ID NO: 6803 - RNA, 19 nt, Artificial Sequence
  Description of Artificial Sequence: Synthetic oligonucleotide
ggugacugcuaacccuccg

SEQ ID NO: 6804 - RNA, 19 nt, Artificial Sequence
  Description of Artificial Sequence: Synthetic oligonucleotide
cggaggguuagcagucacc

SEQ ID NO: 6805 - RNA, 19 nt, Artificial Sequence
  Description of Artificial Sequence: Synthetic oligonucleotide
gugacugcuaacccuccgc

SEQ ID NO: 6806 - RNA, 19 nt, Artificial Sequence
  Description of Artificial Sequence: Synthetic oligonucleotide
gcggaggguuagcagucac

SEQ ID NO: 6807 - RNA, 19 nt, Artificial Sequence
  Description of Artificial Sequence: Synthetic oligonucleotide
ugacugcuaacccuccgcu

SEQ ID NO: 6808 - RNA, 19 nt, Artificial Sequence
  Description of Artificial Sequence: Synthetic oligonucleotide
agcggaggguuagcaguca

SEQ ID NO: 6809 - RNA, 19 nt, Artificial Sequence
  Description of Artificial Sequence: Synthetic oligonucleotide
gacugcuaacccuccgcuc

SEQ ID NO: 6810 - RNA, 19 nt, Artificial Sequence
  Description of Artificial Sequence: Synthetic oligonucleotide
gagcggaggguuagcaguc

SEQ ID NO: 6811 - RNA, 19 nt, Artificial Sequence
  Description of Artificial Sequence: Synthetic oligonucleotide
acugcuaacccuccgcucu

SEQ ID NO: 6812 - RNA, 19 nt, Artificial Sequence
  Description of Artificial Sequence: Synthetic oligonucleotide
agagcggaggguuagcagu

SEQ ID NO: 6813 - RNA, 19 nt, Artificial Sequence
  Description of Artificial Sequence: Synthetic oligonucleotide
cugcuaacccuccgcucua

SEQ ID NO: 6814 - RNA, 19 nt, Artificial Sequence
  Description of Artificial Sequence: Synthetic oligonucleotide
uagagcggaggguuagcag

SEQ ID NO: 6815 - RNA, 19 nt, Artificial Sequence
  Description of Artificial Sequence: Synthetic oligonucleotide
ugcuaacccuccgcucuac

SEQ ID NO: 6816 - RNA, 19 nt, Artificial Sequence
  Description of Artificial Sequence: Synthetic oligonucleotide
guagagcggaggguuagca

SEQ ID NO: 6817 - RNA, 19 nt, Artificial Sequence
  Description of Artificial Sequence: Synthetic oligonucleotide
aacccuccgcucuacccuc

SEQ ID NO: 6818 - RNA, 19 nt, Artificial Sequence
  Description of Artificial Sequence: Synthetic oligonucleotide
gaggguagagcggaggguu

SEQ ID NO: 6819 - RNA, 19 nt, Artificial Sequence
  Description of Artificial Sequence: Synthetic oligonucleotide
acuccacagugggcuuguc

SEQ ID NO: 6820 - RNA, 19 nt, Artificial Sequence
  Description of Artificial Sequence: Synthetic oligonucleotide
gacaagcccacuguggagu

SEQ ID NO: 6821 - RNA, 19 nt, Artificial Sequence
  Description of Artificial Sequence: Synthetic oligonucleotide
cuccacagugggcuuguca

SEQ ID NO: 6822 - RNA, 19 nt, Artificial Sequence
  Description of Artificial Sequence: Synthetic oligonucleotide
ugacaagcccacuguggag

SEQ ID NO: 6823 - RNA, 19 nt, Artificial Sequence
  Description of Artificial Sequence: Synthetic oligonucleotide
uccacagugggcuugucaa

SEQ ID NO: 6824 - RNA, 19 nt, Artificial Sequence
  Description of Artificial Sequence: Synthetic oligonucleotide
uugacaagcccacugugga

SEQ ID NO: 6825 - RNA, 19 nt, Artificial Sequence
  Description of Artificial Sequence: Synthetic oligonucleotide
ccacagugggcuugucaag

SEQ ID NO: 6826 - RNA, 19 nt, Artificial Sequence
  Description of Artificial Sequence: Synthetic oligonucleotide
cuugacaagcccacugugg

SEQ ID NO: 6827 - RNA, 19 nt, Artificial Sequence
  Description of Artificial Sequence: Synthetic oligonucleotide
gucaagcuccugagccacc

SEQ ID NO: 6828 - RNA, 19 nt, Artificial Sequence
  Description of Artificial Sequence: Synthetic oligonucleotide
gguggcucaggagcuugac

SEQ ID NO: 6829 - RNA, 19 nt, Artificial Sequence
  Description of Artificial Sequence: Synthetic oligonucleotide
ccauggucucucccucauc

SEQ ID NO: 6830 - RNA, 19 nt, Artificial Sequence
  Description of Artificial Sequence: Synthetic oligonucleotide
gaugagggagagaccaugg

SEQ ID NO: 6831 - RNA, 19 nt, Artificial Sequence
  Description of Artificial Sequence: Synthetic oligonucleotide
cauggucucucccucaucc

SEQ ID NO: 6832 - RNA, 19 nt, Artificial Sequence
  Description of Artificial Sequence: Synthetic oligonucleotide
ggaugagggagagaccaug

SEQ ID NO: 6833 - RNA, 19 nt, Artificial Sequence
  Description of Artificial Sequence: Synthetic oligonucleotide
auggucucucccucauccc

SEQ ID NO: 6834 - RNA, 19 nt, Artificial Sequence
  Description of Artificial Sequence: Synthetic oligonucleotide
gggaugagggagagaccau

SEQ ID NO: 6835 - RNA, 19 nt, Artificial Sequence
  Description of Artificial Sequence: Synthetic oligonucleotide
ucucucccucaucccuaau

SEQ ID NO: 6836 - RNA, 19 nt, Artificial Sequence
  Description of Artificial Sequence: Synthetic oligonucleotide
auuagggaugagggagaga

SEQ ID NO: 6837 - RNA, 19 nt, Artificial Sequence
  Description of Artificial Sequence: Synthetic oligonucleotide
cucucccucaucccuaauc

SEQ ID NO: 6838 - RNA, 19 nt, Artificial Sequence
  Description of Artificial Sequence: Synthetic oligonucleotide
gauuagggaugagggagag

SEQ ID NO: 6839 - RNA, 19 nt, Artificial Sequence
  Description of Artificial Sequence: Synthetic oligonucleotide
ucucccucaucccuaaucg

SEQ ID NO: 6840 - RNA, 19 nt, Artificial Sequence
  Description of Artificial Sequence: Synthetic oligonucleotide
cgauuagggaugagggaga

SEQ ID NO: 6841 - RNA, 19 nt, Artificial Sequence
  Description of Artificial Sequence: Synthetic oligonucleotide
cucccucaucccuaaucga

SEQ ID NO: 6842 - RNA, 19 nt, Artificial Sequence
  Description of Artificial Sequence: Synthetic oligonucleotide
ucgauuagggaugagggag

SEQ ID NO: 6843 - RNA, 19 nt, Artificial Sequence
  Description of Artificial Sequence: Synthetic oligonucleotide
ucccucaucccuaaucgau

SEQ ID NO: 6844 - RNA, 19 nt, Artificial Sequence
  Description of Artificial Sequence: Synthetic oligonucleotide
aucgauuagggaugaggga

SEQ ID NO: 6845 - RNA, 19 nt, Artificial Sequence
  Description of Artificial Sequence: Synthetic oligonucleotide
cccucaucccuaaucgaua

SEQ ID NO: 6846 - RNA, 19 nt, Artificial Sequence
  Description of Artificial Sequence: Synthetic oligonucleotide
uaucgauuagggaugaggg

SEQ ID NO: 6847 - RNA, 19 nt, Artificial Sequence
  Description of Artificial Sequence: Synthetic oligonucleotide
ccucaucccuaaucgauaa

SEQ ID NO: 6848 - RNA, 19 nt, Artificial Sequence
  Description of Artificial Sequence: Synthetic oligonucleotide
uuaucgauuagggaugagg

SEQ ID NO: 6849 - RNA, 19 nt, Artificial Sequence
  Description of Artificial Sequence: Synthetic oligonucleotide
cucaucccuaaucgauaaa

SEQ ID NO: 6850 - RNA, 19 nt, Artificial Sequence
  Description of Artificial Sequence: Synthetic oligonucleotide
uuuaucgauuagggaugag

SEQ ID NO: 6851 - RNA, 19 nt, Artificial Sequence
  Description of Artificial Sequence: Synthetic oligonucleotide
aaccuagaucucucccucc

SEQ ID NO: 6852 - RNA, 19 nt, Artificial Sequence
  Description of Artificial Sequence: Synthetic oligonucleotide
ggagggagagaucuagguu

SEQ ID NO: 6853 - RNA, 19 nt, Artificial Sequence
  Description of Artificial Sequence: Synthetic oligonucleotide
accuagaucucucccuccc

SEQ ID NO: 6854 - RNA, 19 nt, Artificial Sequence
  Description of Artificial Sequence: Synthetic oligonucleotide
gggagggagagaucuaggu

SEQ ID NO: 6855 - RNA, 19 nt, Artificial Sequence
  Description of Artificial Sequence: Synthetic oligonucleotide
cuagaucucucccucccua

SEQ ID NO: 6856 - RNA, 19 nt, Artificial Sequence
  Description of Artificial Sequence: Synthetic oligonucleotide
uagggagggagagaucuag

SEQ ID NO: 6857 - RNA, 19 nt, Artificial Sequence
  Description of Artificial Sequence: Synthetic oligonucleotide
uagaucucucccucccuag

SEQ ID NO: 6858 - RNA, 19 nt, Artificial Sequence
  Description of Artificial Sequence: Synthetic oligonucleotide
cuagggagggagagaucua

SEQ ID NO: 6859 - RNA, 19 nt, Artificial Sequence
  Description of Artificial Sequence: Synthetic oligonucleotide
agaucucucccucccuagc

SEQ ID NO: 6860 - RNA, 19 nt, Artificial Sequence
  Description of Artificial Sequence: Synthetic oligonucleotide
gcuagggagggagagaucu

SEQ ID NO: 6861 - RNA, 19 nt, Artificial Sequence
  Description of Artificial Sequence: Synthetic oligonucleotide
gaucucucccucccuagcc

SEQ ID NO: 6862 - RNA, 19 nt, Artificial Sequence
  Description of Artificial Sequence: Synthetic oligonucleotide
ggcuagggagggagagauc

SEQ ID NO: 6863 - RNA, 19 nt, Artificial Sequence
  Description of Artificial Sequence: Synthetic oligonucleotide
aucucucccucccuagccc

SEQ ID NO: 6864 - RNA, 19 nt, Artificial Sequence
  Description of Artificial Sequence: Synthetic oligonucleotide
gggcuagggagggagagau

SEQ ID NO: 6865 - RNA, 19 nt, Artificial Sequence
  Description of Artificial Sequence: Synthetic oligonucleotide
uagcccucuagccacucua

SEQ ID NO: 6866 - RNA, 19 nt, Artificial Sequence
  Description of Artificial Sequence: Synthetic oligonucleotide
uagaguggcuagagggcua

SEQ ID NO: 6867 - RNA, 19 nt, Artificial Sequence
  Description of Artificial Sequence: Synthetic oligonucleotide
agcccucuagccacucuac

SEQ ID NO: 6868 - RNA, 19 nt, Artificial Sequence
  Description of Artificial Sequence: Synthetic oligonucleotide
guagaguggcuagagggcu

SEQ ID NO: 6869 - RNA, 19 nt, Artificial Sequence
  Description of Artificial Sequence: Synthetic oligonucleotide
cucuagccacucuacccuc

SEQ ID NO: 6870 - RNA, 19 nt, Artificial Sequence
  Description of Artificial Sequence: Synthetic oligonucleotide
gaggguagaguggcuagag

SEQ ID NO: 6871 - RNA, 19 nt, Artificial Sequence
  Description of Artificial Sequence: Synthetic oligonucleotide
ucuagccacucuacccuca

SEQ ID NO: 6872 - RNA, 19 nt, Artificial Sequence
  Description of Artificial Sequence: Synthetic oligonucleotide
ugaggguagaguggcuaga

SEQ ID NO: 6873 - RNA, 19 nt, Artificial Sequence
  Description of Artificial Sequence: Synthetic oligonucleotide
cuagccacucuacccucau

SEQ ID NO: 6874 - RNA, 19 nt, Artificial Sequence
  Description of Artificial Sequence: Synthetic oligonucleotide
augaggguagaguggcuag

SEQ ID NO: 6875 - RNA, 19 nt, Artificial Sequence
  Description of Artificial Sequence: Synthetic oligonucleotide
uagccacucuacccucauc

SEQ ID NO: 6876 - RNA, 19 nt, Artificial Sequence
  Description of Artificial Sequence: Synthetic oligonucleotide
gaugaggguagaguggcua

SEQ ID NO: 6877 - RNA, 19 nt, Artificial Sequence
  Description of Artificial Sequence: Synthetic oligonucleotide
agccacucuacccucauca

SEQ ID NO: 6878 - RNA, 19 nt, Artificial Sequence
  Description of Artificial Sequence: Synthetic oligonucleotide
ugaugaggguagaguggcu

SEQ ID NO: 6879 - RNA, 19 nt, Artificial Sequence
  Description of Artificial Sequence: Synthetic oligonucleotide
gccacucuacccucaucau

SEQ ID NO: 6880 - RNA, 19 nt, Artificial Sequence
  Description of Artificial Sequence: Synthetic oligonucleotide
augaugaggguagaguggc

SEQ ID NO: 6881 - RNA, 19 nt, Artificial Sequence
  Description of Artificial Sequence: Synthetic oligonucleotide
ccacucuacccucaucaug

SEQ ID NO: 6882 - RNA, 19 nt, Artificial Sequence
  Description of Artificial Sequence: Synthetic oligonucleotide
caugaugaggguagagugg

SEQ ID NO: 6883 - RNA, 19 nt, Artificial Sequence
  Description of Artificial Sequence: Synthetic oligonucleotide
cacucuacccucaucaugc

SEQ ID NO: 6884 - RNA, 19 nt, Artificial Sequence
  Description of Artificial Sequence: Synthetic oligonucleotide
gcaugaugaggguagagug

SEQ ID NO: 6885 - RNA, 19 nt, Artificial Sequence
  Description of Artificial Sequence: Synthetic oligonucleotide
acucuacccucaucaugcc

SEQ ID NO: 6886 - RNA, 19 nt, Artificial Sequence
  Description of Artificial Sequence: Synthetic oligonucleotide
ggcaugaugaggguagagu

SEQ ID NO: 6887 - RNA, 19 nt, Artificial Sequence
  Description of Artificial Sequence: Synthetic oligonucleotide
cucuacccucaucaugccc

SEQ ID NO: 6888 - RNA, 19 nt, Artificial Sequence
  Description of Artificial Sequence: Synthetic oligonucleotide
gggcaugaugaggguagag

SEQ ID NO: 6889 - RNA, 19 nt, Artificial Sequence
  Description of Artificial Sequence: Synthetic oligonucleotide
ucuacccucaucaugcccu

SEQ ID NO: 6890 - RNA, 19 nt, Artificial Sequence
  Description of Artificial Sequence: Synthetic oligonucleotide
agggcaugaugaggguaga

SEQ ID NO: 6891 - RNA, 19 nt, Artificial Sequence
  Description of Artificial Sequence: Synthetic oligonucleotide
cuacccucaucaugcccuu

SEQ ID NO: 6892 - RNA, 19 nt, Artificial Sequence
  Description of Artificial Sequence: Synthetic oligonucleotide
aagggcaugaugaggguag

SEQ ID NO: 6893 - RNA, 19 nt, Artificial Sequence
  Description of Artificial Sequence: Synthetic oligonucleotide
uacccucaucaugcccuuu

SEQ ID NO: 6894 - RNA, 19 nt, Artificial Sequence
  Description of Artificial Sequence: Synthetic oligonucleotide
aaagggcaugaugagggua

SEQ ID NO: 6895 - RNA, 19 nt, Artificial Sequence
  Description of Artificial Sequence: Synthetic oligonucleotide
acccucaucaugcccuuua

SEQ ID NO: 6896 - RNA, 19 nt, Artificial Sequence
  Description of Artificial Sequence: Synthetic oligonucleotide
uaaagggcaugaugagggu

SEQ ID NO: 6897 - RNA, 19 nt, Artificial Sequence
  Description of Artificial Sequence: Synthetic oligonucleotide
cccucaucaugcccuuuac

SEQ ID NO: 6898 - RNA, 19 nt, Artificial Sequence
  Description of Artificial Sequence: Synthetic oligonucleotide
guaaagggcaugaugaggg

SEQ ID NO: 6899 - RNA, 19 nt, Artificial Sequence
  Description of Artificial Sequence: Synthetic oligonucleotide
cucaucaugcccuuuacac

SEQ ID NO: 6900 - RNA, 19 nt, Artificial Sequence
  Description of Artificial Sequence: Synthetic oligonucleotide
guguaaagggcaugaugag

SEQ ID NO: 6901 - RNA, 19 nt, Artificial Sequence
  Description of Artificial Sequence: Synthetic oligonucleotide
ucaucaugcccuuuacacu

SEQ ID NO: 6902 - RNA, 19 nt, Artificial Sequence
  Description of Artificial Sequence: Synthetic oligonucleotide
aguguaaagggcaugauga

SEQ ID NO: 6903 - RNA, 19 nt, Artificial Sequence
  Description of Artificial Sequence: Synthetic oligonucleotide
cccuucuugacuuuucuuc

SEQ ID NO: 6904 - RNA, 19 nt, Artificial Sequence
  Description of Artificial Sequence: Synthetic oligonucleotide
gaagaaaagucaagaaggg

SEQ ID NO: 6905 - RNA, 19 nt, Artificial Sequence
  Description of Artificial Sequence: Synthetic oligonucleotide
cuucuugacuuuucuucuc

SEQ ID NO: 6906 - RNA, 19 nt, Artificial Sequence
  Description of Artificial Sequence: Synthetic oligonucleotide
gagaagaaaagucaagaag

SEQ ID NO: 6907 - RNA, 19 nt, Artificial Sequence
  Description of Artificial Sequence: Synthetic oligonucleotide
gacuuuucuucucaacuac

SEQ ID NO: 6908 - RNA, 19 nt, Artificial Sequence
  Description of Artificial Sequence: Synthetic oligonucleotide
guaguugagaagaaaaguc

SEQ ID NO: 6909 - RNA, 19 nt, Artificial Sequence
  Description of Artificial Sequence: Synthetic oligonucleotide
acuuuucuucucaacuacc

SEQ ID NO: 6910 - RNA, 19 nt, Artificial Sequence
  Description of Artificial Sequence: Synthetic oligonucleotide
gguaguugagaagaaaagu

SEQ ID NO: 6911 - RNA, 19 nt, Artificial Sequence
  Description of Artificial Sequence: Synthetic oligonucleotide
cuuuucuucucaacuacca

SEQ ID NO: 6912 - RNA, 19 nt, Artificial Sequence
  Description of Artificial Sequence: Synthetic oligonucleotide
ugguaguugagaagaaaag

SEQ ID NO: 6913 - RNA, 19 nt, Artificial Sequence
  Description of Artificial Sequence: Synthetic oligonucleotide
uuuucuucucaacuaccag

SEQ ID NO: 6914 - RNA, 19 nt, Artificial Sequence
  Description of Artificial Sequence: Synthetic oligonucleotide
cugguaguugagaagaaaa

SEQ ID NO: 6915 - RNA, 19 nt, Artificial Sequence
  Description of Artificial Sequence: Synthetic oligonucleotide
uaucuaauauaagcucgga

SEQ ID NO: 6916 - RNA, 19 nt, Artificial Sequence
  Description of Artificial Sequence: Synthetic oligonucleotide
uccgagcuuauauuagaua

SEQ ID NO: 6917 - RNA, 19 nt, Artificial Sequence
  Description of Artificial Sequence: Synthetic oligonucleotide
aucuaauauaagcucggag

SEQ ID NO: 6918 - RNA, 19 nt, Artificial Sequence
  Description of Artificial Sequence: Synthetic oligonucleotide
cuccgagcuuauauuagau

SEQ ID NO: 6919 - RNA, 19 nt, Artificial Sequence
  Description of Artificial Sequence: Synthetic oligonucleotide
ucuaauauaagcucggagu

SEQ ID NO: 6920 - RNA, 19 nt, Artificial Sequence
  Description of Artificial Sequence: Synthetic oligonucleotide
acuccgagcuuauauuaga

SEQ ID NO: 6921 - RNA, 19 nt, Artificial Sequence
  Description of Artificial Sequence: Synthetic oligonucleotide
cuaauauaagcucggaguu

SEQ ID NO: 6922 - RNA, 19 nt, Artificial Sequence
  Description of Artificial Sequence: Synthetic oligonucleotide
aacuccgagcuuauauuag

SEQ ID NO: 6923 - RNA, 19 nt, Artificial Sequence
  Description of Artificial Sequence: Synthetic oligonucleotide
uaauauaagcucggaguuu

SEQ ID NO: 6924 - RNA, 19 nt, Artificial Sequence
  Description of Artificial Sequence: Synthetic oligonucleotide
aaacuccgagcuuauauua

SEQ ID NO: 6925 - RNA, 19 nt, Artificial Sequence
  Description of Artificial Sequence: Synthetic oligonucleotide
aauauaagcucggaguuug

SEQ ID NO: 6926 - RNA, 19 nt, Artificial Sequence
  Description of Artificial Sequence: Synthetic oligonucleotide
caaacuccgagcuuauauu

SEQ ID NO: 6927 - RNA, 19 nt, Artificial Sequence
  Description of Artificial Sequence: Synthetic oligonucleotide
auauaagcucggaguuugg

SEQ ID NO: 6928 - RNA, 19 nt, Artificial Sequence
  Description of Artificial Sequence: Synthetic oligonucleotide
ccaaacuccgagcuuauau

SEQ ID NO: 6929 - RNA, 19 nt, Artificial Sequence
  Description of Artificial Sequence: Synthetic oligonucleotide
uauaagcucggaguuugga

SEQ ID NO: 6930 - RNA, 19 nt, Artificial Sequence
  Description of Artificial Sequence: Synthetic oligonucleotide
uccaaacuccgagcuuaua

SEQ ID NO: 6931 - RNA, 19 nt, Artificial Sequence
  Description of Artificial Sequence: Synthetic oligonucleotide
auaagcucggaguuuggac

SEQ ID NO: 6932 - RNA, 19 nt, Artificial Sequence
  Description of Artificial Sequence: Synthetic oligonucleotide
guccaaacuccgagcuuau

SEQ ID NO: 6933 - RNA, 19 nt, Artificial Sequence
  Description of Artificial Sequence: Synthetic oligonucleotide
uaagcucggaguuuggacg

SEQ ID NO: 6934 - RNA, 19 nt, Artificial Sequence
  Description of Artificial Sequence: Synthetic oligonucleotide
cguccaaacuccgagcuua

SEQ ID NO: 6935 - RNA, 19 nt, Artificial Sequence
  Description of Artificial Sequence: Synthetic oligonucleotide
aagcucggaguuuggacgg

SEQ ID NO: 6936 - RNA, 19 nt, Artificial Sequence
  Description of Artificial Sequence: Synthetic oligonucleotide
ccguccaaacuccgagcuu

SEQ ID NO: 6937 - RNA, 19 nt, Artificial Sequence
  Description of Artificial Sequence: Synthetic oligonucleotide
agcucggaguuuggacgga

SEQ ID NO: 6938 - RNA, 19 nt, Artificial Sequence
  Description of Artificial Sequence: Synthetic oligonucleotide
uccguccaaacuccgagcu

SEQ ID NO: 6939 - RNA, 19 nt, Artificial Sequence
  Description of Artificial Sequence: Synthetic oligonucleotide
gcucggaguuuggacggag

SEQ ID NO: 6940 - RNA, 19 nt, Artificial Sequence
  Description of Artificial Sequence: Synthetic oligonucleotide
cuccguccaaacuccgagc

SEQ ID NO: 6941 - RNA, 19 nt, Artificial Sequence
  Description of Artificial Sequence: Synthetic oligonucleotide
cucggaguuuggacggagg

SEQ ID NO: 6942 - RNA, 19 nt, Artificial Sequence
  Description of Artificial Sequence: Synthetic oligonucleotide
ccuccguccaaacuccgag

SEQ ID NO: 6943 - RNA, 19 nt, Artificial Sequence
  Description of Artificial Sequence: Synthetic oligonucleotide
ucggaguuuggacggaggg

SEQ ID NO: 6944 - RNA, 19 nt, Artificial Sequence
  Description of Artificial Sequence: Synthetic oligonucleotide
cccuccguccaaacuccga

SEQ ID NO: 6945 - RNA, 19 nt, Artificial Sequence
  Description of Artificial Sequence: Synthetic oligonucleotide
cggaguuuggacggagggu

SEQ ID NO: 6946 - RNA, 19 nt, Artificial Sequence
  Description of Artificial Sequence: Synthetic oligonucleotide
acccuccguccaaacuccg

SEQ ID NO: 6947 - RNA, 19 nt, Artificial Sequence
  Description of Artificial Sequence: Synthetic oligonucleotide
uuuggacggagggucugga

SEQ ID NO: 6948 - RNA, 19 nt, Artificial Sequence
  Description of Artificial Sequence: Synthetic oligonucleotide
uccagacccuccguccaaa

SEQ ID NO: 6949 - RNA, 19 nt, Artificial Sequence
  Description of Artificial Sequence: Synthetic oligonucleotide
cccagcgaccuuuccgugu

SEQ ID NO: 6950 - RNA, 19 nt, Artificial Sequence
  Description of Artificial Sequence: Synthetic oligonucleotide
acacggaaaggucgcuggg

SEQ ID NO: 6951 - RNA, 19 nt, Artificial Sequence
  Description of Artificial Sequence: Synthetic oligonucleotide
ccagcgaccuuuccguguc

SEQ ID NO: 6952 - RNA, 19 nt, Artificial Sequence
  Description of Artificial Sequence: Synthetic oligonucleotide
gacacggaaaggucgcugg

SEQ ID NO: 6953 - RNA, 19 nt, Artificial Sequence
  Description of Artificial Sequence: Synthetic oligonucleotide
cagcgaccuuuccgugucu

SEQ ID NO: 6954 - RNA, 19 nt, Artificial Sequence
  Description of Artificial Sequence: Synthetic oligonucleotide
agacacggaaaggucgcug

SEQ ID NO: 6955 - RNA, 19 nt, Artificial Sequence
  Description of Artificial Sequence: Synthetic oligonucleotide
agcgaccuuuccgugucug

SEQ ID NO: 6956 - RNA, 19 nt, Artificial Sequence
  Description of Artificial Sequence: Synthetic oligonucleotide
cagacacggaaaggucgcu

SEQ ID NO: 6957 - RNA, 19 nt, Artificial Sequence
  Description of Artificial Sequence: Synthetic oligonucleotide
gcgaccuuuccgugucugu

SEQ ID NO: 6958 - RNA, 19 nt, Artificial Sequence
  Description of Artificial Sequence: Synthetic oligonucleotide
acagacacggaaaggucgc

SEQ ID NO: 6959 - RNA, 19 nt, Artificial Sequence
  Description of Artificial Sequence: Synthetic oligonucleotide
cgaccuuuccgugucugug

SEQ ID NO: 6960 - RNA, 19 nt, Artificial Sequence
  Description of Artificial Sequence: Synthetic oligonucleotide
cacagacacggaaaggucg

SEQ ID NO: 6961 - RNA, 19 nt, Artificial Sequence
  Description of Artificial Sequence: Synthetic oligonucleotide
cuuuccgugucugugauca

SEQ ID NO: 6962 - RNA, 19 nt, Artificial Sequence
  Description of Artificial Sequence: Synthetic oligonucleotide
ugaucacagacacggaaag

SEQ ID NO: 6963 - RNA, 19 nt, Artificial Sequence
  Description of Artificial Sequence: Synthetic oligonucleotide
uuuccgugucugugaucac

SEQ ID NO: 6964 - RNA, 19 nt, Artificial Sequence
  Description of Artificial Sequence: Synthetic oligonucleotide
gugaucacagacacggaaa

SEQ ID NO: 6965 - RNA, 19 nt, Artificial Sequence
  Description of Artificial Sequence: Synthetic oligonucleotide
uuccgugucugugaucaca

SEQ ID NO: 6966 - RNA, 19 nt, Artificial Sequence
  Description of Artificial Sequence: Synthetic oligonucleotide
ugugaucacagacacggaa

SEQ ID NO: 6967 - RNA, 19 nt, Artificial Sequence
  Description of Artificial Sequence: Synthetic oligonucleotide
aaggccugacagcugccac

SEQ ID NO: 6968 - RNA, 19 nt, Artificial Sequence
  Description of Artificial Sequence: Synthetic oligonucleotide
guggcagcugucaggccuu

SEQ ID NO: 6969 - RNA, 19 nt, Artificial Sequence
  Description of Artificial Sequence: Synthetic oligonucleotide
gccaggagcugcuagccaa

SEQ ID NO: 6970 - RNA, 19 nt, Artificial Sequence
  Description of Artificial Sequence: Synthetic oligonucleotide
uuggcuagcagcuccuggc

SEQ ID NO: 6971 - RNA, 19 nt, Artificial Sequence
  Description of Artificial Sequence: Synthetic oligonucleotide
ccaggagcugcuagccaaa

SEQ ID NO: 6972 - RNA, 19 nt, Artificial Sequence
  Description of Artificial Sequence: Synthetic oligonucleotide
uuuggcuagcagcuccugg

SEQ ID NO: 6973 - RNA, 19 nt, Artificial Sequence
  Description of Artificial Sequence: Synthetic oligonucleotide
gagcugcuagccaaaguaa

SEQ ID NO: 6974 - RNA, 19 nt, Artificial Sequence
  Description of Artificial Sequence: Synthetic oligonucleotide
uuacuuuggcuagcagcuc

SEQ ID NO: 6975 - RNA, 19 nt, Artificial Sequence
  Description of Artificial Sequence: Synthetic oligonucleotide
agcugcuagccaaaguaag

SEQ ID NO: 6976 - RNA, 19 nt, Artificial Sequence
  Description of Artificial Sequence: Synthetic oligonucleotide
cuuacuuuggcuagcagcu

SEQ ID NO: 6977 - RNA, 19 nt, Artificial Sequence
  Description of Artificial Sequence: Synthetic oligonucleotide
gcugcuagccaaaguaagu

SEQ ID NO: 6978 - RNA, 19 nt, Artificial Sequence
  Description of Artificial Sequence: Synthetic oligonucleotide
acuuacuuuggcuagcagc

SEQ ID NO: 6979 - RNA, 19 nt, Artificial Sequence
  Description of Artificial Sequence: Synthetic oligonucleotide
cugcuagccaaaguaagua

SEQ ID NO: 6980 - RNA, 19 nt, Artificial Sequence
  Description of Artificial Sequence: Synthetic oligonucleotide
uacuuacuuuggcuagcag

SEQ ID NO: 6981 - RNA, 19 nt, Artificial Sequence
  Description of Artificial Sequence: Synthetic oligonucleotide
ugcuagccaaaguaaguag

SEQ ID NO: 6982 - RNA, 19 nt, Artificial Sequence
  Description of Artificial Sequence: Synthetic oligonucleotide
cuacuuacuuuggcuagca

SEQ ID NO: 6983 - RNA, 19 nt, Artificial Sequence
  Description of Artificial Sequence: Synthetic oligonucleotide
gcuagccaaaguaaguagg

SEQ ID NO: 6984 - RNA, 19 nt, Artificial Sequence
  Description of Artificial Sequence: Synthetic oligonucleotide
ccuacuuacuuuggcuagc

SEQ ID NO: 6985 - RNA, 19 nt, Artificial Sequence
  Description of Artificial Sequence: Synthetic oligonucleotide
uagccaaaguaaguaggcc

SEQ ID NO: 6986 - RNA, 19 nt, Artificial Sequence
  Description of Artificial Sequence: Synthetic oligonucleotide
ggccuacuuacuuuggcua

SEQ ID NO: 6987 - RNA, 19 nt, Artificial Sequence
  Description of Artificial Sequence: Synthetic oligonucleotide
agccaaaguaaguaggcca

SEQ ID NO: 6988 - RNA, 19 nt, Artificial Sequence
  Description of Artificial Sequence: Synthetic oligonucleotide
uggccuacuuacuuuggcu

SEQ ID NO: 6989 - RNA, 19 nt, Artificial Sequence
  Description of Artificial Sequence: Synthetic oligonucleotide
gccaaaguaaguaggccaa

SEQ ID NO: 6990 - RNA, 19 nt, Artificial Sequence
  Description of Artificial Sequence: Synthetic oligonucleotide
uuggccuacuuacuuuggc

SEQ ID NO: 6991 - RNA, 19 nt, Artificial Sequence
  Description of Artificial Sequence: Synthetic oligonucleotide
ccaaaguaaguaggccaag

SEQ ID NO: 6992 - RNA, 19 nt, Artificial Sequence
  Description of Artificial Sequence: Synthetic oligonucleotide
cuuggccuacuuacuuugg

SEQ ID NO: 6993 - RNA, 19 nt, Artificial Sequence
  Description of Artificial Sequence: Synthetic oligonucleotide
caaaguaaguaggccaagu

SEQ ID NO: 6994 - RNA, 19 nt, Artificial Sequence
  Description of Artificial Sequence: Synthetic oligonucleotide
acuuggccuacuuacuuug

SEQ ID NO: 6995 - RNA, 19 nt, Artificial Sequence
  Description of Artificial Sequence: Synthetic oligonucleotide
aaaguaaguaggccaaguu

SEQ ID NO: 6996 - RNA, 19 nt, Artificial Sequence
  Description of Artificial Sequence: Synthetic oligonucleotide
aacuuggccuacuuacuuu

SEQ ID NO: 6997 - RNA, 19 nt, Artificial Sequence
  Description of Artificial Sequence: Synthetic oligonucleotide
aaguaaguaggccaaguuc

SEQ ID NO: 6998 - RNA, 19 nt, Artificial Sequence
  Description of Artificial Sequence: Synthetic oligonucleotide
gaacuuggccuacuuacuu

SEQ ID NO: 6999 - RNA, 19 nt, Artificial Sequence
  Description of Artificial Sequence: Synthetic oligonucleotide
aguaaguaggccaaguucc

SEQ ID NO: 7000 - RNA, 19 nt, Artificial Sequence
  Description of Artificial Sequence: Synthetic oligonucleotide
ggaacuuggccuacuuacu

SEQ ID NO: 7001 - RNA, 19 nt, Artificial Sequence
  Description of Artificial Sequence: Synthetic oligonucleotide
guaaguaggccaaguuccu

SEQ ID NO: 7002 - RNA, 19 nt, Artificial Sequence
  Description of Artificial Sequence: Synthetic oligonucleotide
aggaacuuggccuacuuac

SEQ ID NO: 7003 - RNA, 19 nt, Artificial Sequence
  Description of Artificial Sequence: Synthetic oligonucleotide
uaaguaggccaaguuccuc

SEQ ID NO: 7004 - RNA, 19 nt, Artificial Sequence
  Description of Artificial Sequence: Synthetic oligonucleotide
gaggaacuuggccuacuua

SEQ ID NO: 7005 - RNA, 19 nt, Artificial Sequence
  Description of Artificial Sequence: Synthetic oligonucleotide
uaggccaaguuccucgguu

SEQ ID NO: 7006 - RNA, 19 nt, Artificial Sequence
  Description of Artificial Sequence: Synthetic oligonucleotide
aaccgaggaacuuggccua

SEQ ID NO: 7007 - RNA, 19 nt, Artificial Sequence
  Description of Artificial Sequence: Synthetic oligonucleotide
aggccaaguuccucgguuc

SEQ ID NO: 7008 - RNA, 19 nt, Artificial Sequence
  Description of Artificial Sequence: Synthetic oligonucleotide
gaaccgaggaacuuggccu

SEQ ID NO: 7009 - RNA, 19 nt, Artificial Sequence
  Description of Artificial Sequence: Synthetic oligonucleotide
ggccaaguuccucgguucc

SEQ ID NO: 7010 - RNA, 19 nt, Artificial Sequence
  Description of Artificial Sequence: Synthetic oligonucleotide
ggaaccgaggaacuuggcc

SEQ ID NO: 7011 - RNA, 19 nt, Artificial Sequence
  Description of Artificial Sequence: Synthetic oligonucleotide
gccaaguuccucgguuccu

SEQ ID NO: 7012 - RNA, 19 nt, Artificial Sequence
  Description of Artificial Sequence: Synthetic oligonucleotide
aggaaccgaggaacuuggc

SEQ ID NO: 7013 - RNA, 19 nt, Artificial Sequence
  Description of Artificial Sequence: Synthetic oligonucleotide
ccaaguuccucgguuccua

SEQ ID NO: 7014 - RNA, 19 nt, Artificial Sequence
  Description of Artificial Sequence: Synthetic oligonucleotide
uaggaaccgaggaacuugg

SEQ ID NO: 7015 - RNA, 19 nt, Artificial Sequence
  Description of Artificial Sequence: Synthetic oligonucleotide
caaguuccucgguuccuau

SEQ ID NO: 7016 - RNA, 19 nt, Artificial Sequence
  Description of Artificial Sequence: Synthetic oligonucleotide
auaggaaccgaggaacuug

SEQ ID NO: 7017 - RNA, 19 nt, Artificial Sequence
  Description of Artificial Sequence: Synthetic oligonucleotide
aaguuccucgguuccuaua

SEQ ID NO: 7018 - RNA, 19 nt, Artificial Sequence
  Description of Artificial Sequence: Synthetic oligonucleotide
uauaggaaccgaggaacuu

SEQ ID NO: 7019 - RNA, 19 nt, Artificial Sequence
  Description of Artificial Sequence: Synthetic oligonucleotide
aguuccucgguuccuauag

SEQ ID NO: 7020 - RNA, 19 nt, Artificial Sequence
  Description of Artificial Sequence: Synthetic oligonucleotide
cuauaggaaccgaggaacu

SEQ ID NO: 7021 - RNA, 19 nt, Artificial Sequence
  Description of Artificial Sequence: Synthetic oligonucleotide
guuccucgguuccuauagc

SEQ ID NO: 7022 - RNA, 19 nt, Artificial Sequence
  Description of Artificial Sequence: Synthetic oligonucleotide
gcuauaggaaccgaggaac

SEQ ID NO: 7023 - RNA, 19 nt, Artificial Sequence
  Description of Artificial Sequence: Synthetic oligonucleotide
uuccucgguuccuauagca

SEQ ID NO: 7024 - RNA, 19 nt, Artificial Sequence
  Description of Artificial Sequence: Synthetic oligonucleotide
ugcuauaggaaccgaggaa

SEQ ID NO: 7025 - RNA, 19 nt, Artificial Sequence
  Description of Artificial Sequence: Synthetic oligonucleotide
uccucgguuccuauagcag

SEQ ID NO: 7026 - RNA, 19 nt, Artificial Sequence
  Description of Artificial Sequence: Synthetic oligonucleotide
cugcuauaggaaccgagga

SEQ ID NO: 7027 - RNA, 19 nt, Artificial Sequence
  Description of Artificial Sequence: Synthetic oligonucleotide
caguggcaacuugugauga

SEQ ID NO: 7028 - RNA, 19 nt, Artificial Sequence
  Description of Artificial Sequence: Synthetic oligonucleotide
ucaucacaaguugccacug

SEQ ID NO: 7029 - RNA, 19 nt, Artificial Sequence
  Description of Artificial Sequence: Synthetic oligonucleotide
aguggcaacuugugaugau

SEQ ID NO: 7030 - RNA, 19 nt, Artificial Sequence
  Description of Artificial Sequence: Synthetic oligonucleotide
aucaucacaaguugccacu

SEQ ID NO: 7031 - RNA, 19 nt, Artificial Sequence
  Description of Artificial Sequence: Synthetic oligonucleotide
guggcaacuugugaugaug

SEQ ID NO: 7032 - RNA, 19 nt, Artificial Sequence
  Description of Artificial Sequence: Synthetic oligonucleotide
caucaucacaaguugccac

SEQ ID NO: 7033 - RNA, 19 nt, Artificial Sequence
  Description of Artificial Sequence: Synthetic oligonucleotide
ggcaacuugugaugaugga

SEQ ID NO: 7034 - RNA, 19 nt, Artificial Sequence
  Description of Artificial Sequence: Synthetic oligonucleotide
uccaucaucacaaguugcc

SEQ ID NO: 7035 - RNA, 19 nt, Artificial Sequence
  Description of Artificial Sequence: Synthetic oligonucleotide
acuugugaugauggagcag

SEQ ID NO: 7036 - RNA, 19 nt, Artificial Sequence
  Description of Artificial Sequence: Synthetic oligonucleotide
cugcuccaucaucacaagu

SEQ ID NO: 7037 - RNA, 19 nt, Artificial Sequence
  Description of Artificial Sequence: Synthetic oligonucleotide
cuugugaugauggagcaga

SEQ ID NO: 7038 - RNA, 19 nt, Artificial Sequence
  Description of Artificial Sequence: Synthetic oligonucleotide
ucugcuccaucaucacaag

SEQ ID NO: 7039 - RNA, 19 nt, Artificial Sequence
  Description of Artificial Sequence: Synthetic oligonucleotide
gugaugauggagcagaggg

SEQ ID NO: 7040 - RNA, 19 nt, Artificial Sequence
  Description of Artificial Sequence: Synthetic oligonucleotide
cccucugcuccaucaucac

SEQ ID NO: 7041 - RNA, 19 nt, Artificial Sequence
  Description of Artificial Sequence: Synthetic oligonucleotide
ugaugauggagcagagggc

SEQ ID NO: 7042 - RNA, 19 nt, Artificial Sequence
  Description of Artificial Sequence: Synthetic oligonucleotide
gcccucugcuccaucauca

SEQ ID NO: 7043 - RNA, 19 nt, Artificial Sequence
  Description of Artificial Sequence: Synthetic oligonucleotide
uggagcagagggcugaagu

SEQ ID NO: 7044 - RNA, 19 nt, Artificial Sequence
  Description of Artificial Sequence: Synthetic oligonucleotide
acuucagcccucugcucca

SEQ ID NO: 7045 - RNA, 19 nt, Artificial Sequence
  Description of Artificial Sequence: Synthetic oligonucleotide
ggagcagagggcugaaguc

SEQ ID NO: 7046 - RNA, 19 nt, Artificial Sequence
  Description of Artificial Sequence: Synthetic oligonucleotide
gacuucagcccucugcucc

SEQ ID NO: 7047 - RNA, 19 nt, Artificial Sequence
  Description of Artificial Sequence: Synthetic oligonucleotide
gagcagagggcugaaguca

SEQ ID NO: 7048 - RNA, 19 nt, Artificial Sequence
  Description of Artificial Sequence: Synthetic oligonucleotide
ugacuucagcccucugcuc

SEQ ID NO: 7049 - RNA, 19 nt, Artificial Sequence
  Description of Artificial Sequence: Synthetic oligonucleotide
cuaaaagcagcggaguggg

SEQ ID NO: 7050 - RNA, 19 nt, Artificial Sequence
  Description of Artificial Sequence: Synthetic oligonucleotide
cccacuccgcugcuuuuag

SEQ ID NO: 7051 - RNA, 19 nt, Artificial Sequence
  Description of Artificial Sequence: Synthetic oligonucleotide
uaaaagcagcggagugggc

SEQ ID NO: 7052 - RNA, 19 nt, Artificial Sequence
  Description of Artificial Sequence: Synthetic oligonucleotide
gcccacuccgcugcuuuua

SEQ ID NO: 7053 - RNA, 19 nt, Artificial Sequence
  Description of Artificial Sequence: Synthetic oligonucleotide
aaaagcagcggagugggcc

SEQ ID NO: 7054 - RNA, 19 nt, Artificial Sequence
  Description of Artificial Sequence: Synthetic oligonucleotide
ggcccacuccgcugcuuuu

SEQ ID NO: 7055 - RNA, 19 nt, Artificial Sequence
  Description of Artificial Sequence: Synthetic oligonucleotide
aaagcagcggagugggccu

SEQ ID NO: 7056 - RNA, 19 nt, Artificial Sequence
  Description of Artificial Sequence: Synthetic oligonucleotide
aggcccacuccgcugcuuu

SEQ ID NO: 7057 - RNA, 19 nt, Artificial Sequence
  Description of Artificial Sequence: Synthetic oligonucleotide
aagcagcggagugggccua

SEQ ID NO: 7058 - RNA, 19 nt, Artificial Sequence
  Description of Artificial Sequence: Synthetic oligonucleotide
uaggcccacuccgcugcuu

SEQ ID NO: 7059 - RNA, 19 nt, Artificial Sequence
  Description of Artificial Sequence: Synthetic oligonucleotide
agcagcggagugggccuaa

SEQ ID NO: 7060 - RNA, 19 nt, Artificial Sequence
  Description of Artificial Sequence: Synthetic oligonucleotide
uuaggcccacuccgcugcu

SEQ ID NO: 7061 - RNA, 19 nt, Artificial Sequence
  Description of Artificial Sequence: Synthetic oligonucleotide
gcagcggagugggccuaau

SEQ ID NO: 7062 - RNA, 19 nt, Artificial Sequence
  Description of Artificial Sequence: Synthetic oligonucleotide
auuaggcccacuccgcugc

SEQ ID NO: 7063 - RNA, 19 nt, Artificial Sequence
  Description of Artificial Sequence: Synthetic oligonucleotide
cagcggagugggccuaaug

SEQ ID NO: 7064 - RNA, 19 nt, Artificial Sequence
  Description of Artificial Sequence: Synthetic oligonucleotide
cauuaggcccacuccgcug

SEQ ID NO: 7065 - RNA, 19 nt, Artificial Sequence
  Description of Artificial Sequence: Synthetic oligonucleotide
agcggagugggccuaauga

SEQ ID NO: 7066 - RNA, 19 nt, Artificial Sequence
  Description of Artificial Sequence: Synthetic oligonucleotide
ucauuaggcccacuccgcu

SEQ ID NO: 7067 - RNA, 19 nt, Artificial Sequence
  Description of Artificial Sequence: Synthetic oligonucleotide
gcggagugggccuaaugag

SEQ ID NO: 7068 - RNA, 19 nt, Artificial Sequence
  Description of Artificial Sequence: Synthetic oligonucleotide
cucauuaggcccacuccgc

SEQ ID NO: 7069 - RNA, 19 nt, Artificial Sequence
  Description of Artificial Sequence: Synthetic oligonucleotide
agugggccuaaugagcucu

SEQ ID NO: 7070 - RNA, 19 nt, Artificial Sequence
  Description of Artificial Sequence: Synthetic oligonucleotide
agagcucauuaggcccacu

SEQ ID NO: 7071 - RNA, 19 nt, Artificial Sequence
  Description of Artificial Sequence: Synthetic oligonucleotide
gugggccuaaugagcucug

SEQ ID NO: 7072 - RNA, 19 nt, Artificial Sequence
  Description of Artificial Sequence: Synthetic oligonucleotide
cagagcucauuaggcccac

SEQ ID NO: 7073 - RNA, 19 nt, Artificial Sequence
  Description of Artificial Sequence: Synthetic oligonucleotide
ugggccuaaugagcucugg

SEQ ID NO: 7074 - RNA, 19 nt, Artificial Sequence
  Description of Artificial Sequence: Synthetic oligonucleotide
ccagagcucauuaggccca

SEQ ID NO: 7075 - RNA, 19 nt, Artificial Sequence
  Description of Artificial Sequence: Synthetic oligonucleotide
gggccuaaugagcucuggu

SEQ ID NO: 7076 - RNA, 19 nt, Artificial Sequence
  Description of Artificial Sequence: Synthetic oligonucleotide
accagagcucauuaggccc

SEQ ID NO: 7077 - RNA, 19 nt, Artificial Sequence
  Description of Artificial Sequence: Synthetic oligonucleotide
ggccuaaugagcucugguc

SEQ ID NO: 7078 - RNA, 19 nt, Artificial Sequence
  Description of Artificial Sequence: Synthetic oligonucleotide
gaccagagcucauuaggcc

SEQ ID NO: 7079 - RNA, 19 nt, Artificial Sequence
  Description of Artificial Sequence: Synthetic oligonucleotide
gccuaaugagcucugguca

SEQ ID NO: 7080 - RNA, 19 nt, Artificial Sequence
  Description of Artificial Sequence: Synthetic oligonucleotide
ugaccagagcucauuaggc

SEQ ID NO: 7081 - RNA, 19 nt, Artificial Sequence
  Description of Artificial Sequence: Synthetic oligonucleotide
ccuaaugagcucuggucaa

SEQ ID NO: 7082 - RNA, 19 nt, Artificial Sequence
  Description of Artificial Sequence: Synthetic oligonucleotide
uugaccagagcucauuagg

SEQ ID NO: 7083 - RNA, 19 nt, Artificial Sequence
  Description of Artificial Sequence: Synthetic oligonucleotide
cuaaugagcucuggucaau

SEQ ID NO: 7084 - RNA, 19 nt, Artificial Sequence
  Description of Artificial Sequence: Synthetic oligonucleotide
auugaccagagcucauuag

SEQ ID NO: 7085 - RNA, 19 nt, Artificial Sequence
  Description of Artificial Sequence: Synthetic oligonucleotide
uaaugagcucuggucaauu

SEQ ID NO: 7086 - RNA, 19 nt, Artificial Sequence
  Description of Artificial Sequence: Synthetic oligonucleotide
aauugaccagagcucauua

SEQ ID NO: 7087 - RNA, 19 nt, Artificial Sequence
  Description of Artificial Sequence: Synthetic oligonucleotide
aaugagcucuggucaauuu

SEQ ID NO: 7088 - RNA, 19 nt, Artificial Sequence
  Description of Artificial Sequence: Synthetic oligonucleotide
aaauugaccagagcucauu

SEQ ID NO: 7089 - RNA, 19 nt, Artificial Sequence
  Description of Artificial Sequence: Synthetic oligonucleotide
augagcucuggucaauuug

SEQ ID NO: 7090 - RNA, 19 nt, Artificial Sequence
  Description of Artificial Sequence: Synthetic oligonucleotide
caaauugaccagagcucau

SEQ ID NO: 7091 - RNA, 19 nt, Artificial Sequence
  Description of Artificial Sequence: Synthetic oligonucleotide
ugagcucuggucaauuugu

SEQ ID NO: 7092 - RNA, 19 nt, Artificial Sequence
  Description of Artificial Sequence: Synthetic oligonucleotide
acaaauugaccagagcuca

SEQ ID NO: 7093 - RNA, 19 nt, Artificial Sequence
  Description of Artificial Sequence: Synthetic oligonucleotide
cuggucaauuuguucauuu

SEQ ID NO: 7094 - RNA, 19 nt, Artificial Sequence
  Description of Artificial Sequence: Synthetic oligonucleotide
aaaugaacaaauugaccag

SEQ ID NO: 7095 - RNA, 19 nt, Artificial Sequence
  Description of Artificial Sequence: Synthetic oligonucleotide
caauuuguucauuuuccac

SEQ ID NO: 7096 - RNA, 19 nt, Artificial Sequence
  Description of Artificial Sequence: Synthetic oligonucleotide
guggaaaaugaacaaauug

SEQ ID NO: 7097 - RNA, 19 nt, Artificial Sequence
  Description of Artificial Sequence: Synthetic oligonucleotide
agugagcuuuucuauggga

SEQ ID NO: 7098 - RNA, 19 nt, Artificial Sequence
  Description of Artificial Sequence: Synthetic oligonucleotide
ucccauagaaaagcucacu

SEQ ID NO: 7099 - RNA, 19 nt, Artificial Sequence
  Description of Artificial Sequence: Synthetic oligonucleotide
agcuuuucuaugggagcag

SEQ ID NO: 7100 - RNA, 19 nt, Artificial Sequence
  Description of Artificial Sequence: Synthetic oligonucleotide
cugcucccauagaaaagcu

SEQ ID NO: 7101 - RNA, 19 nt, Artificial Sequence
  Description of Artificial Sequence: Synthetic oligonucleotide
gaauucagaagcuaguaug

SEQ ID NO: 7102 - RNA, 19 nt, Artificial Sequence
  Description of Artificial Sequence: Synthetic oligonucleotide
cauacuagcuucugaauuc

SEQ ID NO: 7103 - RNA, 19 nt, Artificial Sequence
  Description of Artificial Sequence: Synthetic oligonucleotide
auucagaagcuaguaugga

SEQ ID NO: 7104 - RNA, 19 nt, Artificial Sequence
  Description of Artificial Sequence: Synthetic oligonucleotide
uccauacuagcuucugaau

SEQ ID NO: 7105 - RNA, 19 nt, Artificial Sequence
  Description of Artificial Sequence: Synthetic oligonucleotide
uucagaagcuaguauggaa

SEQ ID NO: 7106 - RNA, 19 nt, Artificial Sequence
  Description of Artificial Sequence: Synthetic oligonucleotide
uuccauacuagcuucugaa

SEQ ID NO: 7107 - RNA, 19 nt, Artificial Sequence
  Description of Artificial Sequence: Synthetic oligonucleotide
aaaggugauuugugugaca

SEQ ID NO: 7108 - RNA, 19 nt, Artificial Sequence
  Description of Artificial Sequence: Synthetic oligonucleotide
ugucacacaaaucaccuuu

SEQ ID NO: 7109 - RNA, 19 nt, Artificial Sequence
  Description of Artificial Sequence: Synthetic oligonucleotide
auucugauucugccacuuc

SEQ ID NO: 7110 - RNA, 19 nt, Artificial Sequence
  Description of Artificial Sequence: Synthetic oligonucleotide
gaaguggcagaaucagaau

SEQ ID NO: 7111 - RNA, 19 nt, Artificial Sequence
  Description of Artificial Sequence: Synthetic oligonucleotide
auucugccacuuccugccu

SEQ ID NO: 7112 - RNA, 19 nt, Artificial Sequence
  Description of Artificial Sequence: Synthetic oligonucleotide
aggcaggaaguggcagaau

SEQ ID NO: 7113 - RNA, 19 nt, Artificial Sequence
  Description of Artificial Sequence: Synthetic oligonucleotide
gccacuuccugccugucaa

SEQ ID NO: 7114 - RNA, 19 nt, Artificial Sequence
  Description of Artificial Sequence: Synthetic oligonucleotide
uugacaggcaggaaguggc

SEQ ID NO: 7115 - RNA, 19 nt, Artificial Sequence
  Description of Artificial Sequence: Synthetic oligonucleotide
ccacuuccugccugucaaa

SEQ ID NO: 7116 - RNA, 19 nt, Artificial Sequence
  Description of Artificial Sequence: Synthetic oligonucleotide
uuugacaggcaggaagugg

SEQ ID NO: 7117 - RNA, 19 nt, Artificial Sequence
  Description of Artificial Sequence: Synthetic oligonucleotide
aaccuugggaaguuguuca

SEQ ID NO: 7118 - RNA, 19 nt, Artificial Sequence
  Description of Artificial Sequence: Synthetic oligonucleotide
ugaacaacuucccaagguu

SEQ ID NO: 7119 - RNA, 19 nt, Artificial Sequence
  Description of Artificial Sequence: Synthetic oligonucleotide
accuugggaaguuguucaa

SEQ ID NO: 7120 - RNA, 19 nt, Artificial Sequence
  Description of Artificial Sequence: Synthetic oligonucleotide
uugaacaacuucccaaggu

SEQ ID NO: 7121 - RNA, 19 nt, Artificial Sequence
  Description of Artificial Sequence: Synthetic oligonucleotide
ccuugggaaguuguucaac

SEQ ID NO: 7122 - RNA, 19 nt, Artificial Sequence
  Description of Artificial Sequence: Synthetic oligonucleotide
guugaacaacuucccaagg

SEQ ID NO: 7123 - RNA, 19 nt, Artificial Sequence
  Description of Artificial Sequence: Synthetic oligonucleotide
gggaaguuguucaaccuac

SEQ ID NO: 7124 - RNA, 19 nt, Artificial Sequence
  Description of Artificial Sequence: Synthetic oligonucleotide
guagguugaacaacuuccc

SEQ ID NO: 7125 - RNA, 19 nt, Artificial Sequence
  Description of Artificial Sequence: Synthetic oligonucleotide
ggaaguuguucaaccuacc

SEQ ID NO: 7126 - RNA, 19 nt, Artificial Sequence
  Description of Artificial Sequence: Synthetic oligonucleotide
gguagguugaacaacuucc

SEQ ID NO: 7127 - RNA, 19 nt, Artificial Sequence
  Description of Artificial Sequence: Synthetic oligonucleotide
gaaguuguucaaccuacca

SEQ ID NO: 7128 - RNA, 19 nt, Artificial Sequence
  Description of Artificial Sequence: Synthetic oligonucleotide
ugguagguugaacaacuuc

SEQ ID NO: 7129 - RNA, 19 nt, Artificial Sequence
  Description of Artificial Sequence: Synthetic oligonucleotide
aaguuguucaaccuaccaa

SEQ ID NO: 7130 - RNA, 19 nt, Artificial Sequence
  Description of Artificial Sequence: Synthetic oligonucleotide
uugguagguugaacaacuu

SEQ ID NO: 7131 - RNA, 19 nt, Artificial Sequence
  Description of Artificial Sequence: Synthetic oligonucleotide
aguuguucaaccuaccaaa

SEQ ID NO: 7132 - RNA, 19 nt, Artificial Sequence
  Description of Artificial Sequence: Synthetic oligonucleotide
uuugguagguugaacaacu

SEQ ID NO: 7133 - RNA, 19 nt, Artificial Sequence
  Description of Artificial Sequence: Synthetic oligonucleotide
guuguucaaccuaccaaaa

SEQ ID NO: 7134 - RNA, 19 nt, Artificial Sequence
  Description of Artificial Sequence: Synthetic oligonucleotide
uuuugguagguugaacaac

SEQ ID NO: 7135 - RNA, 19 nt, Artificial Sequence
  Description of Artificial Sequence: Synthetic oligonucleotide
gcaauaauaauacaucacc

SEQ ID NO: 7136 - RNA, 19 nt, Artificial Sequence
  Description of Artificial Sequence: Synthetic oligonucleotide
ggugauguauuauuauugc

SEQ ID NO: 7137 - RNA, 19 nt, Artificial Sequence
  Description of Artificial Sequence: Synthetic oligonucleotide
auaauaauacaucaccucc

SEQ ID NO: 7138 - RNA, 19 nt, Artificial Sequence
  Description of Artificial Sequence: Synthetic oligonucleotide
ggaggugauguauuauuau

SEQ ID NO: 7139 - RNA, 19 nt, Artificial Sequence
  Description of Artificial Sequence: Synthetic oligonucleotide
uaauacaucaccuccuagg

SEQ ID NO: 7140 - RNA, 19 nt, Artificial Sequence
  Description of Artificial Sequence: Synthetic oligonucleotide
ccuaggaggugauguauua

SEQ ID NO: 7141 - RNA, 19 nt, Artificial Sequence
  Description of Artificial Sequence: Synthetic oligonucleotide
aauacaucaccuccuaggg

SEQ ID NO: 7142 - RNA, 19 nt, Artificial Sequence
  Description of Artificial Sequence: Synthetic oligonucleotide
cccuaggaggugauguauu

SEQ ID NO: 7143 - RNA, 19 nt, Artificial Sequence
  Description of Artificial Sequence: Synthetic oligonucleotide
auacaucaccuccuagggu

SEQ ID NO: 7144 - RNA, 19 nt, Artificial Sequence
  Description of Artificial Sequence: Synthetic oligonucleotide
acccuaggaggugauguau

SEQ ID NO: 7145 - RNA, 19 nt, Artificial Sequence
  Description of Artificial Sequence: Synthetic oligonucleotide
uacaucaccuccuaggguu

SEQ ID NO: 7146 - RNA, 19 nt, Artificial Sequence
  Description of Artificial Sequence: Synthetic oligonucleotide
aacccuaggaggugaugua

SEQ ID NO: 7147 - RNA, 19 nt, Artificial Sequence
  Description of Artificial Sequence: Synthetic oligonucleotide
acaucaccuccuaggguug

SEQ ID NO: 7148 - RNA, 19 nt, Artificial Sequence
  Description of Artificial Sequence: Synthetic oligonucleotide
caacccuaggaggugaugu

SEQ ID NO: 7149 - RNA, 19 nt, Artificial Sequence
  Description of Artificial Sequence: Synthetic oligonucleotide
aaaggaguaagaggauaau

SEQ ID NO: 7150 - RNA, 19 nt, Artificial Sequence
  Description of Artificial Sequence: Synthetic oligonucleotide
auuauccucuuacuccuuu

SEQ ID NO: 7151 - RNA, 19 nt, Artificial Sequence
  Description of Artificial Sequence: Synthetic oligonucleotide
aaggaguaagaggauaaug

SEQ ID NO: 7152 - RNA, 19 nt, Artificial Sequence
  Description of Artificial Sequence: Synthetic oligonucleotide
cauuauccucuuacuccuu

SEQ ID NO: 7153 - RNA, 19 nt, Artificial Sequence
  Description of Artificial Sequence: Synthetic oligonucleotide
aguaagaggauaauguagg

SEQ ID NO: 7154 - RNA, 19 nt, Artificial Sequence
  Description of Artificial Sequence: Synthetic oligonucleotide
ccuacauuauccucuuacu

SEQ ID NO: 7155 - RNA, 19 nt, Artificial Sequence
  Description of Artificial Sequence: Synthetic oligonucleotide
guaagaggauaauguaggu

SEQ ID NO: 7156 - RNA, 19 nt, Artificial Sequence
  Description of Artificial Sequence: Synthetic oligonucleotide
accuacauuauccucuuac

SEQ ID NO: 7157 - RNA, 19 nt, Artificial Sequence
  Description of Artificial Sequence: Synthetic oligonucleotide
uaagaggauaauguaggua

SEQ ID NO: 7158 - RNA, 19 nt, Artificial Sequence
  Description of Artificial Sequence: Synthetic oligonucleotide
uaccuacauuauccucuua

SEQ ID NO: 7159 - RNA, 19 nt, Artificial Sequence
  Description of Artificial Sequence: Synthetic oligonucleotide
aagaggauaauguagguaa

SEQ ID NO: 7160 - RNA, 19 nt, Artificial Sequence
  Description of Artificial Sequence: Synthetic oligonucleotide
uuaccuacauuauccucuu

SEQ ID NO: 7161 - RNA, 19 nt, Artificial Sequence
  Description of Artificial Sequence: Synthetic oligonucleotide
agaggauaauguagguaaa

SEQ ID NO: 7162 - RNA, 19 nt, Artificial Sequence
  Description of Artificial Sequence: Synthetic oligonucleotide
uuuaccuacauuauccucu

SEQ ID NO: 7163 - RNA, 19 nt, Artificial Sequence
  Description of Artificial Sequence: Synthetic oligonucleotide
gaggauaauguagguaaag

SEQ ID NO: 7164 - RNA, 19 nt, Artificial Sequence
  Description of Artificial Sequence: Synthetic oligonucleotide
cuuuaccuacauuauccuc

SEQ ID NO: 7165 - RNA, 19 nt, Artificial Sequence
  Description of Artificial Sequence: Synthetic oligonucleotide
ggauaauguagguaaaguc

SEQ ID NO: 7166 - RNA, 19 nt, Artificial Sequence
  Description of Artificial Sequence: Synthetic oligonucleotide
gacuuuaccuacauuaucc

SEQ ID NO: 7167 - RNA, 19 nt, Artificial Sequence
  Description of Artificial Sequence: Synthetic oligonucleotide
auaauguagguaaaguccu

SEQ ID NO: 7168 - RNA, 19 nt, Artificial Sequence
  Description of Artificial Sequence: Synthetic oligonucleotide
aggacuuuaccuacauuau

SEQ ID NO: 7169 - RNA, 19 nt, Artificial Sequence
  Description of Artificial Sequence: Synthetic oligonucleotide
guagguaaaguccucauac

SEQ ID NO: 7170 - RNA, 19 nt, Artificial Sequence
  Description of Artificial Sequence: Synthetic oligonucleotide
guaugaggacuuuaccuac

SEQ ID NO: 7171 - RNA, 19 nt, Artificial Sequence
  Description of Artificial Sequence: Synthetic oligonucleotide
guaaaguccucauaccugg

SEQ ID NO: 7172 - RNA, 19 nt, Artificial Sequence
  Description of Artificial Sequence: Synthetic oligonucleotide
ccagguaugaggacuuuac

SEQ ID NO: 7173 - RNA, 19 nt, Artificial Sequence
  Description of Artificial Sequence: Synthetic oligonucleotide
uaaaguccucauaccuggc

SEQ ID NO: 7174 - RNA, 19 nt, Artificial Sequence
  Description of Artificial Sequence: Synthetic oligonucleotide
gccagguaugaggacuuua

SEQ ID NO: 7175 - RNA, 19 nt, Artificial Sequence
  Description of Artificial Sequence: Synthetic oligonucleotide
aaaguccucauaccuggca

SEQ ID NO: 7176 - RNA, 19 nt, Artificial Sequence
  Description of Artificial Sequence: Synthetic oligonucleotide
ugccagguaugaggacuuu

SEQ ID NO: 7177 - RNA, 19 nt, Artificial Sequence
  Description of Artificial Sequence: Synthetic oligonucleotide
aaguccucauaccuggcac

SEQ ID NO: 7178 - RNA, 19 nt, Artificial Sequence
  Description of Artificial Sequence: Synthetic oligonucleotide
gugccagguaugaggacuu

SEQ ID NO: 7179 - RNA, 19 nt, Artificial Sequence
  Description of Artificial Sequence: Synthetic oligonucleotide
aguccucauaccuggcaca

SEQ ID NO: 7180 - RNA, 19 nt, Artificial Sequence
  Description of Artificial Sequence: Synthetic oligonucleotide
ugugccagguaugaggacu

SEQ ID NO: 7181 - RNA, 19 nt, Artificial Sequence
  Description of Artificial Sequence: Synthetic oligonucleotide
guccucauaccuggcacag

SEQ ID NO: 7182 - RNA, 19 nt, Artificial Sequence
  Description of Artificial Sequence: Synthetic oligonucleotide
cugugccagguaugaggac

SEQ ID NO: 7183 - RNA, 19 nt, Artificial Sequence
  Description of Artificial Sequence: Synthetic oligonucleotide
uccucauaccuggcacaga

SEQ ID NO: 7184 - RNA, 19 nt, Artificial Sequence
  Description of Artificial Sequence: Synthetic oligonucleotide
ucugugccagguaugagga

SEQ ID NO: 7185 - RNA, 19 nt, Artificial Sequence
  Description of Artificial Sequence: Synthetic oligonucleotide
ucuugagggugugggaagu

SEQ ID NO: 7186 - RNA, 19 nt, Artificial Sequence
  Description of Artificial Sequence: Synthetic oligonucleotide
acuucccacacccucaaga

SEQ ID NO: 7187 - RNA, 19 nt, Artificial Sequence
  Description of Artificial Sequence: Synthetic oligonucleotide
cuugagggugugggaagug

SEQ ID NO: 7188 - RNA, 19 nt, Artificial Sequence
  Description of Artificial Sequence: Synthetic oligonucleotide
cacuucccacacccucaag

SEQ ID NO: 7189 - RNA, 19 nt, Artificial Sequence
  Description of Artificial Sequence: Synthetic oligonucleotide
uugagggugugggaaguga

SEQ ID NO: 7190 - RNA, 19 nt, Artificial Sequence
  Description of Artificial Sequence: Synthetic oligonucleotide
ucacuucccacacccucaa

SEQ ID NO: 7191 - RNA, 19 nt, Artificial Sequence
  Description of Artificial Sequence: Synthetic oligonucleotide
ugagggugugggaagugag

SEQ ID NO: 7192 - RNA, 19 nt, Artificial Sequence
  Description of Artificial Sequence: Synthetic oligonucleotide
cucacuucccacacccuca

SEQ ID NO: 7193 - RNA, 19 nt, Artificial Sequence
  Description of Artificial Sequence: Synthetic oligonucleotide
agggugugggaagugaggu

SEQ ID NO: 7194 - RNA, 19 nt, Artificial Sequence
  Description of Artificial Sequence: Synthetic oligonucleotide
accucacuucccacacccu

SEQ ID NO: 7195 - RNA, 19 nt, Artificial Sequence
  Description of Artificial Sequence: Synthetic oligonucleotide
gggugugggaagugaggug

SEQ ID NO: 7196 - RNA, 19 nt, Artificial Sequence
  Description of Artificial Sequence: Synthetic oligonucleotide
caccucacuucccacaccc

SEQ ID NO: 7197 - RNA, 19 nt, Artificial Sequence
  Description of Artificial Sequence: Synthetic oligonucleotide
gggaagugaggugcagcau

SEQ ID NO: 7198 - RNA, 19 nt, Artificial Sequence
  Description of Artificial Sequence: Synthetic oligonucleotide
augcugcaccucacuuccc

SEQ ID NO: 7199 - RNA, 19 nt, Artificial Sequence
  Description of Artificial Sequence: Synthetic oligonucleotide
ggaagugaggugcagcauu

SEQ ID NO: 7200 - RNA, 19 nt, Artificial Sequence
  Description of Artificial Sequence: Synthetic oligonucleotide
aaugcugcaccucacuucc

SEQ ID NO: 7201 - RNA, 19 nt, Artificial Sequence
  Description of Artificial Sequence: Synthetic oligonucleotide
gaagugaggugcagcauug

SEQ ID NO: 7202 - RNA, 19 nt, Artificial Sequence
  Description of Artificial Sequence: Synthetic oligonucleotide
caaugcugcaccucacuuc

SEQ ID NO: 7203 - RNA, 19 nt, Artificial Sequence
  Description of Artificial Sequence: Synthetic oligonucleotide
aagugaggugcagcauugu

SEQ ID NO: 7204 - RNA, 19 nt, Artificial Sequence
  Description of Artificial Sequence: Synthetic oligonucleotide
acaaugcugcaccucacuu

SEQ ID NO: 7205 - RNA, 19 nt, Artificial Sequence
  Description of Artificial Sequence: Synthetic oligonucleotide
agugaggugcagcauugua

SEQ ID NO: 7206 - RNA, 19 nt, Artificial Sequence
  Description of Artificial Sequence: Synthetic oligonucleotide
uacaaugcugcaccucacu

SEQ ID NO: 7207 - RNA, 19 nt, Artificial Sequence
  Description of Artificial Sequence: Synthetic oligonucleotide
gugaggugcagcauuguag

SEQ ID NO: 7208 - RNA, 19 nt, Artificial Sequence
  Description of Artificial Sequence: Synthetic oligonucleotide
cuacaaugcugcaccucac

SEQ ID NO: 7209 - RNA, 19 nt, Artificial Sequence
  Description of Artificial Sequence: Synthetic oligonucleotide
ugaggugcagcauuguaga

SEQ ID NO: 7210 - RNA, 19 nt, Artificial Sequence
  Description of Artificial Sequence: Synthetic oligonucleotide
ucuacaaugcugcaccuca

SEQ ID NO: 7211 - RNA, 19 nt, Artificial Sequence
  Description of Artificial Sequence: Synthetic oligonucleotide
gaggugcagcauuguagau

SEQ ID NO: 7212 - RNA, 19 nt, Artificial Sequence
  Description of Artificial Sequence: Synthetic oligonucleotide
aucuacaaugcugcaccuc

SEQ ID NO: 7213 - RNA, 19 nt, Artificial Sequence
  Description of Artificial Sequence: Synthetic oligonucleotide
aggugcagcauuguagaua

SEQ ID NO: 7214 - RNA, 19 nt, Artificial Sequence
  Description of Artificial Sequence: Synthetic oligonucleotide
uaucuacaaugcugcaccu

SEQ ID NO: 7215 - RNA, 19 nt, Artificial Sequence
  Description of Artificial Sequence: Synthetic oligonucleotide
ggugcagcauuguagauaa

SEQ ID NO: 7216 - RNA, 19 nt, Artificial Sequence
  Description of Artificial Sequence: Synthetic oligonucleotide
uuaucuacaaugcugcacc

SEQ ID NO: 7217 - RNA, 19 nt, Artificial Sequence
  Description of Artificial Sequence: Synthetic oligonucleotide
gugcagcauuguagauaag

SEQ ID NO: 7218 - RNA, 19 nt, Artificial Sequence
  Description of Artificial Sequence: Synthetic oligonucleotide
cuuaucuacaaugcugcac

SEQ ID NO: 7219 - RNA, 19 nt, Artificial Sequence
  Description of Artificial Sequence: Synthetic oligonucleotide
ugcagcauuguagauaaga

SEQ ID NO: 7220 - RNA, 19 nt, Artificial Sequence
  Description of Artificial Sequence: Synthetic oligonucleotide
ucuuaucuacaaugcugca

SEQ ID NO: 7221 - RNA, 19 nt, Artificial Sequence
  Description of Artificial Sequence: Synthetic oligonucleotide
gcauuguagauaagacaga

SEQ ID NO: 7222 - RNA, 19 nt, Artificial Sequence
  Description of Artificial Sequence: Synthetic oligonucleotide
ucugucuuaucuacaaugc

SEQ ID NO: 7223 - RNA, 19 nt, Artificial Sequence
  Description of Artificial Sequence: Synthetic oligonucleotide
cauuguagauaagacagaa

SEQ ID NO: 7224 - RNA, 19 nt, Artificial Sequence
  Description of Artificial Sequence: Synthetic oligonucleotide
uucugucuuaucuacaaug

SEQ ID NO: 7225 - RNA, 19 nt, Artificial Sequence
  Description of Artificial Sequence: Synthetic oligonucleotide
auuguagauaagacagaag

SEQ ID NO: 7226 - RNA, 19 nt, Artificial Sequence
  Description of Artificial Sequence: Synthetic oligonucleotide
cuucugucuuaucuacaau

SEQ ID NO: 7227 - RNA, 19 nt, Artificial Sequence
  Description of Artificial Sequence: Synthetic oligonucleotide
auaagacagaaggguggac

SEQ ID NO: 7228 - RNA, 19 nt, Artificial Sequence
  Description of Artificial Sequence: Synthetic oligonucleotide
guccacccuucugucuuau

SEQ ID NO: 7229 - RNA, 19 nt, Artificial Sequence
  Description of Artificial Sequence: Synthetic oligonucleotide
uaagacagaaggguggacu

SEQ ID NO: 7230 - RNA, 19 nt, Artificial Sequence
  Description of Artificial Sequence: Synthetic oligonucleotide
aguccacccuucugucuua

SEQ ID NO: 7231 - RNA, 19 nt, Artificial Sequence
  Description of Artificial Sequence: Synthetic oligonucleotide
aaccuggcuugcuuuccaa

SEQ ID NO: 7232 - RNA, 19 nt, Artificial Sequence
  Description of Artificial Sequence: Synthetic oligonucleotide
uuggaaagcaagccagguu

SEQ ID NO: 7233 - RNA, 19 nt, Artificial Sequence
  Description of Artificial Sequence: Synthetic oligonucleotide
ccuggcuugcuuuccaauu

SEQ ID NO: 7234 - RNA, 19 nt, Artificial Sequence
  Description of Artificial Sequence: Synthetic oligonucleotide
aauuggaaagcaagccagg

SEQ ID NO: 7235 - RNA, 19 nt, Artificial Sequence
  Description of Artificial Sequence: Synthetic oligonucleotide
accagaagugacuuggagg

SEQ ID NO: 7236 - RNA, 19 nt, Artificial Sequence
  Description of Artificial Sequence: Synthetic oligonucleotide
ccuccaagucacuucuggu

SEQ ID NO: 7237 - RNA, 19 nt, Artificial Sequence
  Description of Artificial Sequence: Synthetic oligonucleotide
ccagaagugacuuggaggg

SEQ ID NO: 7238 - RNA, 19 nt, Artificial Sequence
  Description of Artificial Sequence: Synthetic oligonucleotide
cccuccaagucacuucugg

SEQ ID NO: 7239 - RNA, 19 nt, Artificial Sequence
  Description of Artificial Sequence: Synthetic oligonucleotide
agaugccaaugacauggua

SEQ ID NO: 7240 - RNA, 19 nt, Artificial Sequence
  Description of Artificial Sequence: Synthetic oligonucleotide
uaccaugucauuggcaucu

SEQ ID NO: 7241 - RNA, 19 nt, Artificial Sequence
  Description of Artificial Sequence: Synthetic oligonucleotide
gaugccaaugacaugguag

SEQ ID NO: 7242 - RNA, 19 nt, Artificial Sequence
  Description of Artificial Sequence: Synthetic oligonucleotide
cuaccaugucauuggcauc

SEQ ID NO: 7243 - RNA, 19 nt, Artificial Sequence
  Description of Artificial Sequence: Synthetic oligonucleotide
augccaaugacaugguagg

SEQ ID NO: 7244 - RNA, 19 nt, Artificial Sequence
  Description of Artificial Sequence: Synthetic oligonucleotide
ccuaccaugucauuggcau

SEQ ID NO: 7245 - RNA, 19 nt, Artificial Sequence
  Description of Artificial Sequence: Synthetic oligonucleotide
caaugacaugguaggagca

SEQ ID NO: 7246 - RNA, 19 nt, Artificial Sequence
  Description of Artificial Sequence: Synthetic oligonucleotide
ugcuccuaccaugucauug

SEQ ID NO: 7247 - RNA, 19 nt, Artificial Sequence
  Description of Artificial Sequence: Synthetic oligonucleotide
aaugacaugguaggagcaa

SEQ ID NO: 7248 - RNA, 19 nt, Artificial Sequence
  Description of Artificial Sequence: Synthetic oligonucleotide
uugcuccuaccaugucauu

SEQ ID NO: 7249 - RNA, 19 nt, Artificial Sequence
  Description of Artificial Sequence: Synthetic oligonucleotide
augacaugguaggagcaaa

SEQ ID NO: 7250 - RNA, 19 nt, Artificial Sequence
  Description of Artificial Sequence: Synthetic oligonucleotide
uuugcuccuaccaugucau

SEQ ID NO: 7251 - RNA, 19 nt, Artificial Sequence
  Description of Artificial Sequence: Synthetic oligonucleotide
ugacaugguaggagcaaag

SEQ ID NO: 7252 - RNA, 19 nt, Artificial Sequence
  Description of Artificial Sequence: Synthetic oligonucleotide
cuuugcuccuaccauguca

SEQ ID NO: 7253 - RNA, 19 nt, Artificial Sequence
  Description of Artificial Sequence: Synthetic oligonucleotide
gacaugguaggagcaaaga

SEQ ID NO: 7254 - RNA, 19 nt, Artificial Sequence
  Description of Artificial Sequence: Synthetic oligonucleotide
ucuuugcuccuaccauguc

SEQ ID NO: 7255 - RNA, 19 nt, Artificial Sequence
  Description of Artificial Sequence: Synthetic oligonucleotide
aaaaggucagccucuagcu

SEQ ID NO: 7256 - RNA, 19 nt, Artificial Sequence
  Description of Artificial Sequence: Synthetic oligonucleotide
agcuagaggcugaccuuuu

SEQ ID NO: 7257 - RNA, 19 nt, Artificial Sequence
  Description of Artificial Sequence: Synthetic oligonucleotide
aaaggucagccucuagcua

SEQ ID NO: 7258 - RNA, 19 nt, Artificial Sequence
  Description of Artificial Sequence: Synthetic oligonucleotide
uagcuagaggcugaccuuu

SEQ ID NO: 7259 - RNA, 19 nt, Artificial Sequence
  Description of Artificial Sequence: Synthetic oligonucleotide
aggucagccucuagcuagg

SEQ ID NO: 7260 - RNA, 19 nt, Artificial Sequence
  Description of Artificial Sequence: Synthetic oligonucleotide
ccuagcuagaggcugaccu

SEQ ID NO: 7261 - RNA, 19 nt, Artificial Sequence
  Description of Artificial Sequence: Synthetic oligonucleotide
ggucagccucuagcuagga

SEQ ID NO: 7262 - RNA, 19 nt, Artificial Sequence
  Description of Artificial Sequence: Synthetic oligonucleotide
uccuagcuagaggcugacc

SEQ ID NO: 7263 - RNA, 19 nt, Artificial Sequence
  Description of Artificial Sequence: Synthetic oligonucleotide
gucagccucuagcuaggau

SEQ ID NO: 7264 - RNA, 19 nt, Artificial Sequence
  Description of Artificial Sequence: Synthetic oligonucleotide
auccuagcuagaggcugac

SEQ ID NO: 7265 - RNA, 19 nt, Artificial Sequence
  Description of Artificial Sequence: Synthetic oligonucleotide
cagccucuagcuaggaucc

SEQ ID NO: 7266 - RNA, 19 nt, Artificial Sequence
  Description of Artificial Sequence: Synthetic oligonucleotide
ggauccuagcuagaggcug

SEQ ID NO: 7267 - RNA, 19 nt, Artificial Sequence
  Description of Artificial Sequence: Synthetic oligonucleotide
agccucuagcuaggauccc

SEQ ID NO: 7268 - RNA, 19 nt, Artificial Sequence
  Description of Artificial Sequence: Synthetic oligonucleotide
gggauccuagcuagaggcu

SEQ ID NO: 7269 - RNA, 19 nt, Artificial Sequence
  Description of Artificial Sequence: Synthetic oligonucleotide
agagcugcaaccuuuagga

SEQ ID NO: 7270 - RNA, 19 nt, Artificial Sequence
  Description of Artificial Sequence: Synthetic oligonucleotide
uccuaaagguugcagcucu

SEQ ID NO: 7271 - RNA, 19 nt, Artificial Sequence
  Description of Artificial Sequence: Synthetic oligonucleotide
gagcugcaaccuuuaggag

SEQ ID NO: 7272 - RNA, 19 nt, Artificial Sequence
  Description of Artificial Sequence: Synthetic oligonucleotide
cuccuaaagguugcagcuc

SEQ ID NO: 7273 - RNA, 19 nt, Artificial Sequence
  Description of Artificial Sequence: Synthetic oligonucleotide
agcugcaaccuuuaggagg

SEQ ID NO: 7274 - RNA, 19 nt, Artificial Sequence
  Description of Artificial Sequence: Synthetic oligonucleotide
ccuccuaaagguugcagcu

SEQ ID NO: 7275 - RNA, 19 nt, Artificial Sequence
  Description of Artificial Sequence: Synthetic oligonucleotide
uuuaggagguaucaaagug

SEQ ID NO: 7276 - RNA, 19 nt, Artificial Sequence
  Description of Artificial Sequence: Synthetic oligonucleotide
cacuuugauaccuccuaaa

SEQ ID NO: 7277 - RNA, 19 nt, Artificial Sequence
  Description of Artificial Sequence: Synthetic oligonucleotide
uuaggagguaucaaagugc

SEQ ID NO: 7278 - RNA, 19 nt, Artificial Sequence
  Description of Artificial Sequence: Synthetic oligonucleotide
gcacuuugauaccuccuaa

SEQ ID NO: 7279 - RNA, 19 nt, Artificial Sequence
  Description of Artificial Sequence: Synthetic oligonucleotide
uaggagguaucaaagugcc

SEQ ID NO: 7280 - RNA, 19 nt, Artificial Sequence
  Description of Artificial Sequence: Synthetic oligonucleotide
ggcacuuugauaccuccua

SEQ ID NO: 7281 - RNA, 19 nt, Artificial Sequence
  Description of Artificial Sequence: Synthetic oligonucleotide
gucaaagugggacaucgac

SEQ ID NO: 7282 - RNA, 19 nt, Artificial Sequence
  Description of Artificial Sequence: Synthetic oligonucleotide
gucgaugucccacuuugac

SEQ ID NO: 7283 - RNA, 19 nt, Artificial Sequence
  Description of Artificial Sequence: Synthetic oligonucleotide
caucgaccaaugucuagag

SEQ ID NO: 7284 - RNA, 19 nt, Artificial Sequence
  Description of Artificial Sequence: Synthetic oligonucleotide
cucuagacauuggucgaug

SEQ ID NO: 7285 - RNA, 19 nt, Artificial Sequence
  Description of Artificial Sequence: Synthetic oligonucleotide
aucgaccaaugucuagagc

SEQ ID NO: 7286 - RNA, 19 nt, Artificial Sequence
  Description of Artificial Sequence: Synthetic oligonucleotide
gcucuagacauuggucgau

SEQ ID NO: 7287 - RNA, 19 nt, Artificial Sequence
  Description of Artificial Sequence: Synthetic oligonucleotide
accaaugucuagagccaac

SEQ ID NO: 7288 - RNA, 19 nt, Artificial Sequence
  Description of Artificial Sequence: Synthetic oligonucleotide
guuggcucuagacauuggu

SEQ ID NO: 7289 - RNA, 19 nt, Artificial Sequence
  Description of Artificial Sequence: Synthetic oligonucleotide
caaugucuagagccaacug

SEQ ID NO: 7290 - RNA, 19 nt, Artificial Sequence
  Description of Artificial Sequence: Synthetic oligonucleotide
caguuggcucuagacauug

SEQ ID NO: 7291 - RNA, 19 nt, Artificial Sequence
  Description of Artificial Sequence: Synthetic oligonucleotide
aaugucuagagccaacuga

SEQ ID NO: 7292 - RNA, 19 nt, Artificial Sequence
  Description of Artificial Sequence: Synthetic oligonucleotide
ucaguuggcucuagacauu

SEQ ID NO: 7293 - RNA, 19 nt, Artificial Sequence
  Description of Artificial Sequence: Synthetic oligonucleotide
augucuagagccaacugau

SEQ ID NO: 7294 - RNA, 19 nt, Artificial Sequence
  Description of Artificial Sequence: Synthetic oligonucleotide
aucaguuggcucuagacau

SEQ ID NO: 7295 - RNA, 19 nt, Artificial Sequence
  Description of Artificial Sequence: Synthetic oligonucleotide
ugucuagagccaacugaug

SEQ ID NO: 7296 - RNA, 19 nt, Artificial Sequence
  Description of Artificial Sequence: Synthetic oligonucleotide
caucaguuggcucuagaca

SEQ ID NO: 7297 - RNA, 19 nt, Artificial Sequence
  Description of Artificial Sequence: Synthetic oligonucleotide
gucuagagccaacugaugg

SEQ ID NO: 7298 - RNA, 19 nt, Artificial Sequence
  Description of Artificial Sequence: Synthetic oligonucleotide
ccaucaguuggcucuagac

SEQ ID NO: 7299 - RNA, 19 nt, Artificial Sequence
  Description of Artificial Sequence: Synthetic oligonucleotide
ucuagagccaacugaugga

SEQ ID NO: 7300 - RNA, 19 nt, Artificial Sequence
  Description of Artificial Sequence: Synthetic oligonucleotide
uccaucaguuggcucuaga

SEQ ID NO: 7301 - RNA, 19 nt, Artificial Sequence
  Description of Artificial Sequence: Synthetic oligonucleotide
cuagagccaacugauggau

SEQ ID NO: 7302 - RNA, 19 nt, Artificial Sequence
  Description of Artificial Sequence: Synthetic oligonucleotide
auccaucaguuggcucuag

SEQ ID NO: 7303 - RNA, 19 nt, Artificial Sequence
  Description of Artificial Sequence: Synthetic oligonucleotide
uagagccaacugauggaug

SEQ ID NO: 7304 - RNA, 19 nt, Artificial Sequence
  Description of Artificial Sequence: Synthetic oligonucleotide
cauccaucaguuggcucua

SEQ ID NO: 7305 - RNA, 19 nt, Artificial Sequence
  Description of Artificial Sequence: Synthetic oligonucleotide
agagccaacugauggaugu

SEQ ID NO: 7306 - RNA, 19 nt, Artificial Sequence
  Description of Artificial Sequence: Synthetic oligonucleotide
acauccaucaguuggcucu

SEQ ID NO: 7307 - RNA, 19 nt, Artificial Sequence
  Description of Artificial Sequence: Synthetic oligonucleotide
gagccaacugauggauguu

SEQ ID NO: 7308 - RNA, 19 nt, Artificial Sequence
  Description of Artificial Sequence: Synthetic oligonucleotide
aacauccaucaguuggcuc

SEQ ID NO: 7309 - RNA, 19 nt, Artificial Sequence
  Description of Artificial Sequence: Synthetic oligonucleotide
aacugauggauguugggca

SEQ ID NO: 7310 - RNA, 19 nt, Artificial Sequence
  Description of Artificial Sequence: Synthetic oligonucleotide
ugcccaacauccaucaguu

SEQ ID NO: 7311 - RNA, 19 nt, Artificial Sequence
  Description of Artificial Sequence: Synthetic oligonucleotide
uggauguugggcagcuaaa

SEQ ID NO: 7312 - RNA, 19 nt, Artificial Sequence
  Description of Artificial Sequence: Synthetic oligonucleotide
uuuagcugcccaacaucca

SEQ ID NO: 7313 - RNA, 19 nt, Artificial Sequence
  Description of Artificial Sequence: Synthetic oligonucleotide
ggauguugggcagcuaaag

SEQ ID NO: 7314 - RNA, 19 nt, Artificial Sequence
  Description of Artificial Sequence: Synthetic oligonucleotide
cuuuagcugcccaacaucc

SEQ ID NO: 7315 - RNA, 19 nt, Artificial Sequence
  Description of Artificial Sequence: Synthetic oligonucleotide
gauguugggcagcuaaaga

SEQ ID NO: 7316 - RNA, 19 nt, Artificial Sequence
  Description of Artificial Sequence: Synthetic oligonucleotide
ucuuuagcugcccaacauc

SEQ ID NO: 7317 - RNA, 19 nt, Artificial Sequence
  Description of Artificial Sequence: Synthetic oligonucleotide
uugggcagcuaaagaggga

SEQ ID NO: 7318 - RNA, 19 nt, Artificial Sequence
  Description of Artificial Sequence: Synthetic oligonucleotide
ucccucuuuagcugcccaa

SEQ ID NO: 7319 - RNA, 19 nt, Artificial Sequence
  Description of Artificial Sequence: Synthetic oligonucleotide
ugggcagcuaaagagggaa

SEQ ID NO: 7320 - RNA, 19 nt, Artificial Sequence
  Description of Artificial Sequence: Synthetic oligonucleotide
uucccucuuuagcugccca

SEQ ID NO: 7321 - RNA, 19 nt, Artificial Sequence
  Description of Artificial Sequence: Synthetic oligonucleotide
gggcagcuaaagagggaag

SEQ ID NO: 7322 - RNA, 19 nt, Artificial Sequence
  Description of Artificial Sequence: Synthetic oligonucleotide
cuucccucuuuagcugccc

SEQ ID NO: 7323 - RNA, 19 nt, Artificial Sequence
  Description of Artificial Sequence: Synthetic oligonucleotide
ggcagcuaaagagggaagg

SEQ ID NO: 7324 - RNA, 19 nt, Artificial Sequence
  Description of Artificial Sequence: Synthetic oligonucleotide
ccuucccucuuuagcugcc

SEQ ID NO: 7325 - RNA, 19 nt, Artificial Sequence
  Description of Artificial Sequence: Synthetic oligonucleotide
gcagcuaaagagggaaggg

SEQ ID NO: 7326 - RNA, 19 nt, Artificial Sequence
  Description of Artificial Sequence: Synthetic oligonucleotide
cccuucccucuuuagcugc

SEQ ID NO: 7327 - RNA, 19 nt, Artificial Sequence
  Description of Artificial Sequence: Synthetic oligonucleotide
gggcaugggauaagaccug

SEQ ID NO: 7328 - RNA, 19 nt, Artificial Sequence
  Description of Artificial Sequence: Synthetic oligonucleotide
caggucuuaucccaugccc

SEQ ID NO: 7329 - RNA, 19 nt, Artificial Sequence
  Description of Artificial Sequence: Synthetic oligonucleotide
ggcaugggauaagaccugc

SEQ ID NO: 7330 - RNA, 19 nt, Artificial Sequence
  Description of Artificial Sequence: Synthetic oligonucleotide
gcaggucuuaucccaugcc

SEQ ID NO: 7331 - RNA, 19 nt, Artificial Sequence
  Description of Artificial Sequence: Synthetic oligonucleotide
gcaugggauaagaccugcc

SEQ ID NO: 7332 - RNA, 19 nt, Artificial Sequence
  Description of Artificial Sequence: Synthetic oligonucleotide
ggcaggucuuaucccaugc

SEQ ID NO: 7333 - RNA, 19 nt, Artificial Sequence
  Description of Artificial Sequence: Synthetic oligonucleotide
caugggauaagaccugccc

SEQ ID NO: 7334 - RNA, 19 nt, Artificial Sequence
  Description of Artificial Sequence: Synthetic oligonucleotide
gggcaggucuuaucccaug

SEQ ID NO: 7335 - RNA, 19 nt, Artificial Sequence
  Description of Artificial Sequence: Synthetic oligonucleotide
augggauaagaccugcccu

SEQ ID NO: 7336 - RNA, 19 nt, Artificial Sequence
  Description of Artificial Sequence: Synthetic oligonucleotide
agggcaggucuuaucccau

SEQ ID NO: 7337 - RNA, 19 nt, Artificial Sequence
  Description of Artificial Sequence: Synthetic oligonucleotide
ugggauaagaccugcccuu

SEQ ID NO: 7338 - RNA, 19 nt, Artificial Sequence
  Description of Artificial Sequence: Synthetic oligonucleotide
aagggcaggucuuauccca

SEQ ID NO: 7339 - RNA, 19 nt, Artificial Sequence
  Description of Artificial Sequence: Synthetic oligonucleotide
gggauaagaccugcccuuc

SEQ ID NO: 7340 - RNA, 19 nt, Artificial Sequence
  Description of Artificial Sequence: Synthetic oligonucleotide
gaagggcaggucuuauccc

SEQ ID NO: 7341 - RNA, 19 nt, Artificial Sequence
  Description of Artificial Sequence: Synthetic oligonucleotide
ggauaagaccugcccuucu

SEQ ID NO: 7342 - RNA, 19 nt, Artificial Sequence
  Description of Artificial Sequence: Synthetic oligonucleotide
agaagggcaggucuuaucc

SEQ ID NO: 7343 - RNA, 19 nt, Artificial Sequence
  Description of Artificial Sequence: Synthetic oligonucleotide
agaccugcccuucuugcuu

SEQ ID NO: 7344 - RNA, 19 nt, Artificial Sequence
  Description of Artificial Sequence: Synthetic oligonucleotide
aagcaagaagggcaggucu

SEQ ID NO: 7345 - RNA, 19 nt, Artificial Sequence
  Description of Artificial Sequence: Synthetic oligonucleotide
gaccugcccuucuugcuuc

SEQ ID NO: 7346 - RNA, 19 nt, Artificial Sequence
  Description of Artificial Sequence: Synthetic oligonucleotide
gaagcaagaagggcagguc

SEQ ID NO: 7347 - RNA, 19 nt, Artificial Sequence
  Description of Artificial Sequence: Synthetic oligonucleotide
ccugcccuucuugcuucuu

SEQ ID NO: 7348 - RNA, 19 nt, Artificial Sequence
  Description of Artificial Sequence: Synthetic oligonucleotide
aagaagcaagaagggcagg

SEQ ID NO: 7349 - RNA, 19 nt, Artificial Sequence
  Description of Artificial Sequence: Synthetic oligonucleotide
cugcccuucuugcuucuug

SEQ ID NO: 7350 - RNA, 19 nt, Artificial Sequence
  Description of Artificial Sequence: Synthetic oligonucleotide
caagaagcaagaagggcag

SEQ ID NO: 7351 - RNA, 19 nt, Artificial Sequence
  Description of Artificial Sequence: Synthetic oligonucleotide
ugcccuucuugcuucuugc

SEQ ID NO: 7352 - RNA, 19 nt, Artificial Sequence
  Description of Artificial Sequence: Synthetic oligonucleotide
gcaagaagcaagaagggca

SEQ ID NO: 7353 - RNA, 19 nt, Artificial Sequence
  Description of Artificial Sequence: Synthetic oligonucleotide
ucuugcuucuugccauugg

SEQ ID NO: 7354 - RNA, 19 nt, Artificial Sequence
  Description of Artificial Sequence: Synthetic oligonucleotide
ccaauggcaagaagcaaga

SEQ ID NO: 7355 - RNA, 19 nt, Artificial Sequence
  Description of Artificial Sequence: Synthetic oligonucleotide
cuugcuucuugccauuggg

SEQ ID NO: 7356 - RNA, 19 nt, Artificial Sequence
  Description of Artificial Sequence: Synthetic oligonucleotide
cccaauggcaagaagcaag

SEQ ID NO: 7357 - RNA, 19 nt, Artificial Sequence
  Description of Artificial Sequence: Synthetic oligonucleotide
uugcuucuugccauugggc

SEQ ID NO: 7358 - RNA, 19 nt, Artificial Sequence
  Description of Artificial Sequence: Synthetic oligonucleotide
gcccaauggcaagaagcaa

SEQ ID NO: 7359 - RNA, 19 nt, Artificial Sequence
  Description of Artificial Sequence: Synthetic oligonucleotide
ccauugggcaggcauugga

SEQ ID NO: 7360 - RNA, 19 nt, Artificial Sequence
  Description of Artificial Sequence: Synthetic oligonucleotide
uccaaugccugcccaaugg

SEQ ID NO: 7361 - RNA, 19 nt, Artificial Sequence
  Description of Artificial Sequence: Synthetic oligonucleotide
cauugggcaggcauuggag

SEQ ID NO: 7362 - RNA, 19 nt, Artificial Sequence
  Description of Artificial Sequence: Synthetic oligonucleotide
cuccaaugccugcccaaug

SEQ ID NO: 7363 - RNA, 19 nt, Artificial Sequence
  Description of Artificial Sequence: Synthetic oligonucleotide
gacccuacugcugaaugga

SEQ ID NO: 7364 - RNA, 19 nt, Artificial Sequence
  Description of Artificial Sequence: Synthetic oligonucleotide
uccauucagcaguaggguc

SEQ ID NO: 7365 - RNA, 19 nt, Artificial Sequence
  Description of Artificial Sequence: Synthetic oligonucleotide
uacugcugaauggagugcu

SEQ ID NO: 7366 - RNA, 19 nt, Artificial Sequence
  Description of Artificial Sequence: Synthetic oligonucleotide
agcacuccauucagcagua

SEQ ID NO: 7367 - RNA, 19 nt, Artificial Sequence
  Description of Artificial Sequence: Synthetic oligonucleotide
acugcugaauggagugcua

SEQ ID NO: 7368 - RNA, 19 nt, Artificial Sequence
  Description of Artificial Sequence: Synthetic oligonucleotide
uagcacuccauucagcagu

SEQ ID NO: 7369 - RNA, 19 nt, Artificial Sequence
  Description of Artificial Sequence: Synthetic oligonucleotide
cugcugaauggagugcuaa

SEQ ID NO: 7370 - RNA, 19 nt, Artificial Sequence
  Description of Artificial Sequence: Synthetic oligonucleotide
uuagcacuccauucagcag

SEQ ID NO: 7371 - RNA, 19 nt, Artificial Sequence
  Description of Artificial Sequence: Synthetic oligonucleotide
ugcugaauggagugcuaac

SEQ ID NO: 7372 - RNA, 19 nt, Artificial Sequence
  Description of Artificial Sequence: Synthetic oligonucleotide
guuagcacuccauucagca

SEQ ID NO: 7373 - RNA, 19 nt, Artificial Sequence
  Description of Artificial Sequence: Synthetic oligonucleotide
gcugaauggagugcuaacc

SEQ ID NO: 7374 - RNA, 19 nt, Artificial Sequence
  Description of Artificial Sequence: Synthetic oligonucleotide
gguuagcacuccauucagc

SEQ ID NO: 7375 - RNA, 19 nt, Artificial Sequence
  Description of Artificial Sequence: Synthetic oligonucleotide
cugaauggagugcuaaccc

SEQ ID NO: 7376 - RNA, 19 nt, Artificial Sequence
  Description of Artificial Sequence: Synthetic oligonucleotide
ggguuagcacuccauucag

SEQ ID NO: 7377 - RNA, 19 nt, Artificial Sequence
  Description of Artificial Sequence: Synthetic oligonucleotide
uaacccuggugcuagagga

SEQ ID NO: 7378 - RNA, 19 nt, Artificial Sequence
  Description of Artificial Sequence: Synthetic oligonucleotide
uccucuagcaccaggguua

SEQ ID NO: 7379 - RNA, 19 nt, Artificial Sequence
  Description of Artificial Sequence: Synthetic oligonucleotide
aacccuggugcuagaggag

SEQ ID NO: 7380 - RNA, 19 nt, Artificial Sequence
  Description of Artificial Sequence: Synthetic oligonucleotide
cuccucuagcaccaggguu

SEQ ID NO: 7381 - RNA, 19 nt, Artificial Sequence
  Description of Artificial Sequence: Synthetic oligonucleotide
acccuggugcuagaggagg

SEQ ID NO: 7382 - RNA, 19 nt, Artificial Sequence
  Description of Artificial Sequence: Synthetic oligonucleotide
ccuccucuagcaccagggu

SEQ ID NO: 7383 - RNA, 19 nt, Artificial Sequence
  Description of Artificial Sequence: Synthetic oligonucleotide
cccuggugcuagaggagga

SEQ ID NO: 7384 - RNA, 19 nt, Artificial Sequence
  Description of Artificial Sequence: Synthetic oligonucleotide
uccuccucuagcaccaggg

SEQ ID NO: 7385 - RNA, 19 nt, Artificial Sequence
  Description of Artificial Sequence: Synthetic oligonucleotide
ccuggugcuagaggaggau

SEQ ID NO: 7386 - RNA, 19 nt, Artificial Sequence
  Description of Artificial Sequence: Synthetic oligonucleotide
auccuccucuagcaccagg

SEQ ID NO: 7387 - RNA, 19 nt, Artificial Sequence
  Description of Artificial Sequence: Synthetic oligonucleotide
cuggugcuagaggaggaug

SEQ ID NO: 7388 - RNA, 19 nt, Artificial Sequence
  Description of Artificial Sequence: Synthetic oligonucleotide
cauccuccucuagcaccag

SEQ ID NO: 7389 - RNA, 19 nt, Artificial Sequence
  Description of Artificial Sequence: Synthetic oligonucleotide
ggugcuagaggaggaugga

SEQ ID NO: 7390 - RNA, 19 nt, Artificial Sequence
  Description of Artificial Sequence: Synthetic oligonucleotide
uccauccuccucuagcacc

SEQ ID NO: 7391 - RNA, 19 nt, Artificial Sequence
  Description of Artificial Sequence: Synthetic oligonucleotide
gugcuagaggaggauggaa

SEQ ID NO: 7392 - RNA, 19 nt, Artificial Sequence
  Description of Artificial Sequence: Synthetic oligonucleotide
uuccauccuccucuagcac

SEQ ID NO: 7393 - RNA, 19 nt, Artificial Sequence
  Description of Artificial Sequence: Synthetic oligonucleotide
cugcaguggacagugagga

SEQ ID NO: 7394 - RNA, 19 nt, Artificial Sequence
  Description of Artificial Sequence: Synthetic oligonucleotide
uccucacuguccacugcag

SEQ ID NO: 7395 - RNA, 19 nt, Artificial Sequence
  Description of Artificial Sequence: Synthetic oligonucleotide
ugcaguggacagugaggac

SEQ ID NO: 7396 - RNA, 19 nt, Artificial Sequence
  Description of Artificial Sequence: Synthetic oligonucleotide
guccucacuguccacugca

SEQ ID NO: 7397 - RNA, 19 nt, Artificial Sequence
  Description of Artificial Sequence: Synthetic oligonucleotide
gcaguggacagugaggacu

SEQ ID NO: 7398 - RNA, 19 nt, Artificial Sequence
  Description of Artificial Sequence: Synthetic oligonucleotide
aguccucacuguccacugc

SEQ ID NO: 7399 - RNA, 19 nt, Artificial Sequence
  Description of Artificial Sequence: Synthetic oligonucleotide
caguggacagugaggacuu

SEQ ID NO: 7400 - RNA, 19 nt, Artificial Sequence
  Description of Artificial Sequence: Synthetic oligonucleotide
aaguccucacuguccacug

SEQ ID NO: 7401 - RNA, 19 nt, Artificial Sequence
  Description of Artificial Sequence: Synthetic oligonucleotide
aguggacagugaggacuuc

SEQ ID NO: 7402 - RNA, 19 nt, Artificial Sequence
  Description of Artificial Sequence: Synthetic oligonucleotide
gaaguccucacuguccacu

SEQ ID NO: 7403 - RNA, 19 nt, Artificial Sequence
  Description of Artificial Sequence: Synthetic oligonucleotide
guggacagugaggacuucu

SEQ ID NO: 7404 - RNA, 19 nt, Artificial Sequence
  Description of Artificial Sequence: Synthetic oligonucleotide
agaaguccucacuguccac

SEQ ID NO: 7405 - RNA, 19 nt, Artificial Sequence
  Description of Artificial Sequence: Synthetic oligonucleotide
uggacagugaggacuucuu

SEQ ID NO: 7406 - RNA, 19 nt, Artificial Sequence
  Description of Artificial Sequence: Synthetic oligonucleotide
aagaaguccucacugucca

SEQ ID NO: 7407 - RNA, 19 nt, Artificial Sequence
  Description of Artificial Sequence: Synthetic oligonucleotide
ggacagugaggacuucuuc

SEQ ID NO: 7408 - RNA, 19 nt, Artificial Sequence
  Description of Artificial Sequence: Synthetic oligonucleotide
gaagaaguccucacugucc

SEQ ID NO: 7409 - RNA, 19 nt, Artificial Sequence
  Description of Artificial Sequence: Synthetic oligonucleotide
agugaggacuucuuccagc

SEQ ID NO: 7410 - RNA, 19 nt, Artificial Sequence
  Description of Artificial Sequence: Synthetic oligonucleotide
gcuggaagaaguccucacu

SEQ ID NO: 7411 - RNA, 19 nt, Artificial Sequence
  Description of Artificial Sequence: Synthetic oligonucleotide
gugaggacuucuuccagcu

SEQ ID NO: 7412 - RNA, 19 nt, Artificial Sequence
  Description of Artificial Sequence: Synthetic oligonucleotide
agcuggaagaaguccucac

SEQ ID NO: 7413 - RNA, 19 nt, Artificial Sequence
  Description of Artificial Sequence: Synthetic oligonucleotide
ugaggacuucuuccagcug

SEQ ID NO: 7414 - RNA, 19 nt, Artificial Sequence
  Description of Artificial Sequence: Synthetic oligonucleotide
cagcuggaagaaguccuca

SEQ ID NO: 7415 - RNA, 19 nt, Artificial Sequence
  Description of Artificial Sequence: Synthetic oligonucleotide
gaggacuucuuccagcugc

SEQ ID NO: 7416 - RNA, 19 nt, Artificial Sequence
  Description of Artificial Sequence: Synthetic oligonucleotide
gcagcuggaagaaguccuc

SEQ ID NO: 7417 - RNA, 19 nt, Artificial Sequence
  Description of Artificial Sequence: Synthetic oligonucleotide
gugccugaugguguugcag

SEQ ID NO: 7418 - RNA, 19 nt, Artificial Sequence
  Description of Artificial Sequence: Synthetic oligonucleotide
cugcaacaccaucaggcac

SEQ ID NO: 7419 - RNA, 19 nt, Artificial Sequence
  Description of Artificial Sequence: Synthetic oligonucleotide
gaugguguugcagucuggu

SEQ ID NO: 7420 - RNA, 19 nt, Artificial Sequence
  Description of Artificial Sequence: Synthetic oligonucleotide
accagacugcaacaccauc

SEQ ID NO: 7421 - RNA, 19 nt, Artificial Sequence
  Description of Artificial Sequence: Synthetic oligonucleotide
ugguguugcagucugguca

SEQ ID NO: 7422 - RNA, 19 nt, Artificial Sequence
  Description of Artificial Sequence: Synthetic oligonucleotide
ugaccagacugcaacacca

SEQ ID NO: 7423 - RNA, 19 nt, Artificial Sequence
  Description of Artificial Sequence: Synthetic oligonucleotide
gguguugcagucuggucag

SEQ ID NO: 7424 - RNA, 19 nt, Artificial Sequence
  Description of Artificial Sequence: Synthetic oligonucleotide
cugaccagacugcaacacc

SEQ ID NO: 7425 - RNA, 19 nt, Artificial Sequence
  Description of Artificial Sequence: Synthetic oligonucleotide
guguugcagucuggucaga

SEQ ID NO: 7426 - RNA, 19 nt, Artificial Sequence
  Description of Artificial Sequence: Synthetic oligonucleotide
ucugaccagacugcaacac

SEQ ID NO: 7427 - RNA, 19 nt, Artificial Sequence
  Description of Artificial Sequence: Synthetic oligonucleotide
ugcagucuggucagagcug

SEQ ID NO: 7428 - RNA, 19 nt, Artificial Sequence
  Description of Artificial Sequence: Synthetic oligonucleotide
cagcucugaccagacugca

SEQ ID NO: 7429 - RNA, 19 nt, Artificial Sequence
  Description of Artificial Sequence: Synthetic oligonucleotide
gcagucuggucagagcugg

SEQ ID NO: 7430 - RNA, 19 nt, Artificial Sequence
  Description of Artificial Sequence: Synthetic oligonucleotide
ccagcucugaccagacugc

SEQ ID NO: 7431 - RNA, 19 nt, Artificial Sequence
  Description of Artificial Sequence: Synthetic oligonucleotide
cagucuggucagagcugga

SEQ ID NO: 7432 - RNA, 19 nt, Artificial Sequence
  Description of Artificial Sequence: Synthetic oligonucleotide
uccagcucugaccagacug

SEQ ID NO: 7433 - RNA, 19 nt, Artificial Sequence
  Description of Artificial Sequence: Synthetic oligonucleotide
agucuggucagagcuggag

SEQ ID NO: 7434 - RNA, 19 nt, Artificial Sequence
  Description of Artificial Sequence: Synthetic oligonucleotide
cuccagcucugaccagacu

SEQ ID NO: 7435 - RNA, 19 nt, Artificial Sequence
  Description of Artificial Sequence: Synthetic oligonucleotide
gucuggucagagcuggagc

SEQ ID NO: 7436 - RNA, 19 nt, Artificial Sequence
  Description of Artificial Sequence: Synthetic oligonucleotide
gcuccagcucugaccagac

SEQ ID NO: 7437 - RNA, 19 nt, Artificial Sequence
  Description of Artificial Sequence: Synthetic oligonucleotide
ucuggucagagcuggagcc

SEQ ID NO: 7438 - RNA, 19 nt, Artificial Sequence
  Description of Artificial Sequence: Synthetic oligonucleotide
ggcuccagcucugaccaga

SEQ ID NO: 7439 - RNA, 19 nt, Artificial Sequence
  Description of Artificial Sequence: Synthetic oligonucleotide
uggucagagcuggagcccu

SEQ ID NO: 7440 - RNA, 19 nt, Artificial Sequence
  Description of Artificial Sequence: Synthetic oligonucleotide
agggcuccagcucugacca

SEQ ID NO: 7441 - RNA, 19 nt, Artificial Sequence
  Description of Artificial Sequence: Synthetic oligonucleotide
ggucagagcuggagcccua

SEQ ID NO: 7442 - RNA, 19 nt, Artificial Sequence
  Description of Artificial Sequence: Synthetic oligonucleotide
uagggcuccagcucugacc

SEQ ID NO: 7443 - RNA, 19 nt, Artificial Sequence
  Description of Artificial Sequence: Synthetic oligonucleotide
gucagagcuggagcccuac

SEQ ID NO: 7444 - RNA, 19 nt, Artificial Sequence
  Description of Artificial Sequence: Synthetic oligonucleotide
guagggcuccagcucugac

SEQ ID NO: 7445 - RNA, 19 nt, Artificial Sequence
  Description of Artificial Sequence: Synthetic oligonucleotide
caaggguaagaggccuaua

SEQ ID NO: 7446 - RNA, 19 nt, Artificial Sequence
  Description of Artificial Sequence: Synthetic oligonucleotide
uauaggccucuuacccuug

SEQ ID NO: 7447 - RNA, 19 nt, Artificial Sequence
  Description of Artificial Sequence: Synthetic oligonucleotide
aaggguaagaggccuauac

SEQ ID NO: 7448 - RNA, 19 nt, Artificial Sequence
  Description of Artificial Sequence: Synthetic oligonucleotide
guauaggccucuuacccuu

SEQ ID NO: 7449 - RNA, 19 nt, Artificial Sequence
  Description of Artificial Sequence: Synthetic oligonucleotide
aggguaagaggccuauacu

SEQ ID NO: 7450 - RNA, 19 nt, Artificial Sequence
  Description of Artificial Sequence: Synthetic oligonucleotide
aguauaggccucuuacccu

SEQ ID NO: 7451 - RNA, 19 nt, Artificial Sequence
  Description of Artificial Sequence: Synthetic oligonucleotide
ggguaagaggccuauacug

SEQ ID NO: 7452 - RNA, 19 nt, Artificial Sequence
  Description of Artificial Sequence: Synthetic oligonucleotide
caguauaggccucuuaccc

SEQ ID NO: 7453 - RNA, 19 nt, Artificial Sequence
  Description of Artificial Sequence: Synthetic oligonucleotide
gguaagaggccuauacugg

SEQ ID NO: 7454 - RNA, 19 nt, Artificial Sequence
  Description of Artificial Sequence: Synthetic oligonucleotide
ccaguauaggccucuuacc

SEQ ID NO: 7455 - RNA, 19 nt, Artificial Sequence
  Description of Artificial Sequence: Synthetic oligonucleotide
guaagaggccuauacuggg

SEQ ID NO: 7456 - RNA, 19 nt, Artificial Sequence
  Description of Artificial Sequence: Synthetic oligonucleotide
cccaguauaggccucuuac

SEQ ID NO: 7457 - RNA, 19 nt, Artificial Sequence
  Description of Artificial Sequence: Synthetic oligonucleotide
gggcugcuuccaaugccug

SEQ ID NO: 7458 - RNA, 19 nt, Artificial Sequence
  Description of Artificial Sequence: Synthetic oligonucleotide
caggcauuggaagcagccc

SEQ ID NO: 7459 - RNA, 19 nt, Artificial Sequence
  Description of Artificial Sequence: Synthetic oligonucleotide
ggcugcuuccaaugccugu

SEQ ID NO: 7460 - RNA, 19 nt, Artificial Sequence
  Description of Artificial Sequence: Synthetic oligonucleotide
acaggcauuggaagcagcc

SEQ ID NO: 7461 - RNA, 19 nt, Artificial Sequence
  Description of Artificial Sequence: Synthetic oligonucleotide
gcugcuuccaaugccuguc

SEQ ID NO: 7462 - RNA, 19 nt, Artificial Sequence
  Description of Artificial Sequence: Synthetic oligonucleotide
gacaggcauuggaagcagc

SEQ ID NO: 7463 - RNA, 19 nt, Artificial Sequence
  Description of Artificial Sequence: Synthetic oligonucleotide
cugcuuccaaugccugucc

SEQ ID NO: 7464 - RNA, 19 nt, Artificial Sequence
  Description of Artificial Sequence: Synthetic oligonucleotide
ggacaggcauuggaagcag

SEQ ID NO: 7465 - RNA, 19 nt, Artificial Sequence
  Description of Artificial Sequence: Synthetic oligonucleotide
ugcuuccaaugccuguccu

SEQ ID NO: 7466 - RNA, 19 nt, Artificial Sequence
  Description of Artificial Sequence: Synthetic oligonucleotide
aggacaggcauuggaagca

SEQ ID NO: 7467 - RNA, 19 nt, Artificial Sequence
  Description of Artificial Sequence: Synthetic oligonucleotide
gcuuccaaugccuguccuu

SEQ ID NO: 7468 - RNA, 19 nt, Artificial Sequence
  Description of Artificial Sequence: Synthetic oligonucleotide
aaggacaggcauuggaagc

SEQ ID NO: 7469 - RNA, 19 nt, Artificial Sequence
  Description of Artificial Sequence: Synthetic oligonucleotide
cuuccaaugccuguccuuu

SEQ ID NO: 7470 - RNA, 19 nt, Artificial Sequence
  Description of Artificial Sequence: Synthetic oligonucleotide
aaaggacaggcauuggaag

SEQ ID NO: 7471 - RNA, 19 nt, Artificial Sequence
  Description of Artificial Sequence: Synthetic oligonucleotide
uuccaaugccuguccuuua

SEQ ID NO: 7472 - RNA, 19 nt, Artificial Sequence
  Description of Artificial Sequence: Synthetic oligonucleotide
uaaaggacaggcauuggaa

SEQ ID NO: 7473 - RNA, 19 nt, Artificial Sequence
  Description of Artificial Sequence: Synthetic oligonucleotide
uccaaugccuguccuuuag

SEQ ID NO: 7474 - RNA, 19 nt, Artificial Sequence
  Description of Artificial Sequence: Synthetic oligonucleotide
cuaaaggacaggcauugga

SEQ ID NO: 7475 - RNA, 19 nt, Artificial Sequence
  Description of Artificial Sequence: Synthetic oligonucleotide
caaugccuguccuuuagag

SEQ ID NO: 7476 - RNA, 19 nt, Artificial Sequence
  Description of Artificial Sequence: Synthetic oligonucleotide
cucuaaaggacaggcauug

SEQ ID NO: 7477 - RNA, 19 nt, Artificial Sequence
  Description of Artificial Sequence: Synthetic oligonucleotide
aaugccuguccuuuagagc

SEQ ID NO: 7478 - RNA, 19 nt, Artificial Sequence
  Description of Artificial Sequence: Synthetic oligonucleotide
gcucuaaaggacaggcauu

SEQ ID NO: 7479 - RNA, 19 nt, Artificial Sequence
  Description of Artificial Sequence: Synthetic oligonucleotide
augccuguccuuuagagcu

SEQ ID NO: 7480 - RNA, 19 nt, Artificial Sequence
  Description of Artificial Sequence: Synthetic oligonucleotide
agcucuaaaggacaggcau

SEQ ID NO: 7481 - RNA, 19 nt, Artificial Sequence
  Description of Artificial Sequence: Synthetic oligonucleotide
cuuccucucuagcuuaacc

SEQ ID NO: 7482 - RNA, 19 nt, Artificial Sequence
  Description of Artificial Sequence: Synthetic oligonucleotide
gguuaagcuagagaggaag

SEQ ID NO: 7483 - RNA, 19 nt, Artificial Sequence
  Description of Artificial Sequence: Synthetic oligonucleotide
uuccucucuagcuuaaccc

SEQ ID NO: 7484 - RNA, 19 nt, Artificial Sequence
  Description of Artificial Sequence: Synthetic oligonucleotide
ggguuaagcuagagaggaa

SEQ ID NO: 7485 - RNA, 19 nt, Artificial Sequence
  Description of Artificial Sequence: Synthetic oligonucleotide
ucucuagcuuaacccugau

SEQ ID NO: 7486 - RNA, 19 nt, Artificial Sequence
  Description of Artificial Sequence: Synthetic oligonucleotide
aucaggguuaagcuagaga

SEQ ID NO: 7487 - RNA, 19 nt, Artificial Sequence
  Description of Artificial Sequence: Synthetic oligonucleotide
uagcuuaacccugauccug

SEQ ID NO: 7488 - RNA, 19 nt, Artificial Sequence
  Description of Artificial Sequence: Synthetic oligonucleotide
caggaucaggguuaagcua

SEQ ID NO: 7489 - RNA, 19 nt, Artificial Sequence
  Description of Artificial Sequence: Synthetic oligonucleotide
gaccaggugcaggaggagu

SEQ ID NO: 7490 - RNA, 19 nt, Artificial Sequence
  Description of Artificial Sequence: Synthetic oligonucleotide
acuccuccugcaccugguc

SEQ ID NO: 7491 - RNA, 19 nt, Artificial Sequence
  Description of Artificial Sequence: Synthetic oligonucleotide
accaggugcaggaggaguu

SEQ ID NO: 7492 - RNA, 19 nt, Artificial Sequence
  Description of Artificial Sequence: Synthetic oligonucleotide
aacuccuccugcaccuggu

SEQ ID NO: 7493 - RNA, 19 nt, Artificial Sequence
  Description of Artificial Sequence: Synthetic oligonucleotide
ccaggugcaggaggaguug

SEQ ID NO: 7494 - RNA, 19 nt, Artificial Sequence
  Description of Artificial Sequence: Synthetic oligonucleotide
caacuccuccugcaccugg

SEQ ID NO: 7495 - RNA, 19 nt, Artificial Sequence
  Description of Artificial Sequence: Synthetic oligonucleotide
caggugcaggaggaguugu

SEQ ID NO: 7496 - RNA, 19 nt, Artificial Sequence
  Description of Artificial Sequence: Synthetic oligonucleotide
acaacuccuccugcaccug

SEQ ID NO: 7497 - RNA, 19 nt, Artificial Sequence
  Description of Artificial Sequence: Synthetic oligonucleotide
aggugcaggaggaguugug

SEQ ID NO: 7498 - RNA, 19 nt, Artificial Sequence
  Description of Artificial Sequence: Synthetic oligonucleotide
cacaacuccuccugcaccu

SEQ ID NO: 7499 - RNA, 19 nt, Artificial Sequence
  Description of Artificial Sequence: Synthetic oligonucleotide
ugcaggaggaguuguggaa

SEQ ID NO: 7500 - RNA, 19 nt, Artificial Sequence
  Description of Artificial Sequence: Synthetic oligonucleotide
uuccacaacuccuccugca

SEQ ID NO: 7501 - RNA, 19 nt, Artificial Sequence
  Description of Artificial Sequence: Synthetic oligonucleotide
gcaggaggaguuguggaau

SEQ ID NO: 7502 - RNA, 19 nt, Artificial Sequence
  Description of Artificial Sequence: Synthetic oligonucleotide
auuccacaacuccuccugc

SEQ ID NO: 7503 - RNA, 19 nt, Artificial Sequence
  Description of Artificial Sequence: Synthetic oligonucleotide
aggaggaguuguggaauug

SEQ ID NO: 7504 - RNA, 19 nt, Artificial Sequence
  Description of Artificial Sequence: Synthetic oligonucleotide
caauuccacaacuccuccu

SEQ ID NO: 7505 - RNA, 19 nt, Artificial Sequence
  Description of Artificial Sequence: Synthetic oligonucleotide
ggaggaguuguggaauugu

SEQ ID NO: 7506 - RNA, 19 nt, Artificial Sequence
  Description of Artificial Sequence: Synthetic oligonucleotide
acaauuccacaacuccucc

SEQ ID NO: 7507 - RNA, 19 nt, Artificial Sequence
  Description of Artificial Sequence: Synthetic oligonucleotide
gaggaguuguggaauuguc

SEQ ID NO: 7508 - RNA, 19 nt, Artificial Sequence
  Description of Artificial Sequence: Synthetic oligonucleotide
gacaauuccacaacuccuc

SEQ ID NO: 7509 - RNA, 19 nt, Artificial Sequence
  Description of Artificial Sequence: Synthetic oligonucleotide
aggaguuguggaauuguca

SEQ ID NO: 7510 - RNA, 19 nt, Artificial Sequence
  Description of Artificial Sequence: Synthetic oligonucleotide
ugacaauuccacaacuccu

SEQ ID NO: 7511 - RNA, 19 nt, Artificial Sequence
  Description of Artificial Sequence: Synthetic oligonucleotide
ggaguuguggaauugucaa

SEQ ID NO: 7512 - RNA, 19 nt, Artificial Sequence
  Description of Artificial Sequence: Synthetic oligonucleotide
uugacaauuccacaacucc

SEQ ID NO: 7513 - RNA, 19 nt, Artificial Sequence
  Description of Artificial Sequence: Synthetic oligonucleotide
gaguuguggaauugucaag

SEQ ID NO: 7514 - RNA, 19 nt, Artificial Sequence
  Description of Artificial Sequence: Synthetic oligonucleotide
cuugacaauuccacaacuc

SEQ ID NO: 7515 - RNA, 19 nt, Artificial Sequence
  Description of Artificial Sequence: Synthetic oligonucleotide
aguuguggaauugucaagg

SEQ ID NO: 7516 - RNA, 19 nt, Artificial Sequence
  Description of Artificial Sequence: Synthetic oligonucleotide
ccuugacaauuccacaacu

SEQ ID NO: 7517 - RNA, 19 nt, Artificial Sequence
  Description of Artificial Sequence: Synthetic oligonucleotide
guuguggaauugucaagga

SEQ ID NO: 7518 - RNA, 19 nt, Artificial Sequence
  Description of Artificial Sequence: Synthetic oligonucleotide
uccuugacaauuccacaac

SEQ ID NO: 7519 - RNA, 19 nt, Artificial Sequence
  Description of Artificial Sequence: Synthetic oligonucleotide
uggaauugucaaggauguc

SEQ ID NO: 7520 - RNA, 19 nt, Artificial Sequence
  Description of Artificial Sequence: Synthetic oligonucleotide
gacauccuugacaauucca

SEQ ID NO: 7521 - RNA, 19 nt, Artificial Sequence
  Description of Artificial Sequence: Synthetic oligonucleotide
ggaauugucaaggauguca

SEQ ID NO: 7522 - RNA, 19 nt, Artificial Sequence
  Description of Artificial Sequence: Synthetic oligonucleotide
ugacauccuugacaauucc

SEQ ID NO: 7523 - RNA, 19 nt, Artificial Sequence
  Description of Artificial Sequence: Synthetic oligonucleotide
aguccaagcgagggagggu

SEQ ID NO: 7524 - RNA, 19 nt, Artificial Sequence
  Description of Artificial Sequence: Synthetic oligonucleotide
acccucccucgcuuggacu

SEQ ID NO: 7525 - RNA, 19 nt, Artificial Sequence
  Description of Artificial Sequence: Synthetic oligonucleotide
caagcgagggagggucuga

SEQ ID NO: 7526 - RNA, 19 nt, Artificial Sequence
  Description of Artificial Sequence: Synthetic oligonucleotide
ucagacccucccucgcuug

SEQ ID NO: 7527 - RNA, 19 nt, Artificial Sequence
  Description of Artificial Sequence: Synthetic oligonucleotide
aagcgagggagggucugac

SEQ ID NO: 7528 - RNA, 19 nt, Artificial Sequence
  Description of Artificial Sequence: Synthetic oligonucleotide
gucagacccucccucgcuu

SEQ ID NO: 7529 - RNA, 19 nt, Artificial Sequence
  Description of Artificial Sequence: Synthetic oligonucleotide
cugacccagugcugaugga

SEQ ID NO: 7530 - RNA, 19 nt, Artificial Sequence
  Description of Artificial Sequence: Synthetic oligonucleotide
uccaucagcacugggucag

SEQ ID NO: 7531 - RNA, 19 nt, Artificial Sequence
  Description of Artificial Sequence: Synthetic oligonucleotide
agauuaguggugggugucu

SEQ ID NO: 7532 - RNA, 19 nt, Artificial Sequence
  Description of Artificial Sequence: Synthetic oligonucleotide
agacacccaccacuaaucu

SEQ ID NO: 7533 - RNA, 19 nt, Artificial Sequence
  Description of Artificial Sequence: Synthetic oligonucleotide
auuaguggugggugucugg

SEQ ID NO: 7534 - RNA, 19 nt, Artificial Sequence
  Description of Artificial Sequence: Synthetic oligonucleotide
ccagacacccaccacuaau

SEQ ID NO: 7535 - RNA, 19 nt, Artificial Sequence
  Description of Artificial Sequence: Synthetic oligonucleotide
uuaguggugggugucuggu

SEQ ID NO: 7536 - RNA, 19 nt, Artificial Sequence
  Description of Artificial Sequence: Synthetic oligonucleotide
accagacacccaccacuaa

SEQ ID NO: 7537 - RNA, 19 nt, Artificial Sequence
  Description of Artificial Sequence: Synthetic oligonucleotide
uaguggugggugucuggua

SEQ ID NO: 7538 - RNA, 19 nt, Artificial Sequence
  Description of Artificial Sequence: Synthetic oligonucleotide
uaccagacacccaccacua

SEQ ID NO: 7539 - RNA, 19 nt, Artificial Sequence
  Description of Artificial Sequence: Synthetic oligonucleotide
aguggugggugucugguau

SEQ ID NO: 7540 - RNA, 19 nt, Artificial Sequence
  Description of Artificial Sequence: Synthetic oligonucleotide
auaccagacacccaccacu

SEQ ID NO: 7541 - RNA, 19 nt, Artificial Sequence
  Description of Artificial Sequence: Synthetic oligonucleotide
guggugggugucugguaug

SEQ ID NO: 7542 - RNA, 19 nt, Artificial Sequence
  Description of Artificial Sequence: Synthetic oligonucleotide
cauaccagacacccaccac

SEQ ID NO: 7543 - RNA, 19 nt, Artificial Sequence
  Description of Artificial Sequence: Synthetic oligonucleotide
uggugggugucugguauga

SEQ ID NO: 7544 - RNA, 19 nt, Artificial Sequence
  Description of Artificial Sequence: Synthetic oligonucleotide
ucauaccagacacccacca

SEQ ID NO: 7545 - RNA, 19 nt, Artificial Sequence
  Description of Artificial Sequence: Synthetic oligonucleotide
ggugggugucugguaugag

SEQ ID NO: 7546 - RNA, 19 nt, Artificial Sequence
  Description of Artificial Sequence: Synthetic oligonucleotide
cucauaccagacacccacc

SEQ ID NO: 7547 - RNA, 19 nt, Artificial Sequence
  Description of Artificial Sequence: Synthetic oligonucleotide
gugggugucugguaugagg

SEQ ID NO: 7548 - RNA, 19 nt, Artificial Sequence
  Description of Artificial Sequence: Synthetic oligonucleotide
ccucauaccagacacccac

SEQ ID NO: 7549 - RNA, 19 nt, Artificial Sequence
  Description of Artificial Sequence: Synthetic oligonucleotide
ugggugucugguaugagga

SEQ ID NO: 7550 - RNA, 19 nt, Artificial Sequence
  Description of Artificial Sequence: Synthetic oligonucleotide
uccucauaccagacaccca

SEQ ID NO: 7551 - RNA, 19 nt, Artificial Sequence
  Description of Artificial Sequence: Synthetic oligonucleotide
gggugucugguaugaggau

SEQ ID NO: 7552 - RNA, 19 nt, Artificial Sequence
  Description of Artificial Sequence: Synthetic oligonucleotide
auccucauaccagacaccc

SEQ ID NO: 7553 - RNA, 19 nt, Artificial Sequence
  Description of Artificial Sequence: Synthetic oligonucleotide
ggugucugguaugaggauc

SEQ ID NO: 7554 - RNA, 19 nt, Artificial Sequence
  Description of Artificial Sequence: Synthetic oligonucleotide
gauccucauaccagacacc

SEQ ID NO: 7555 - RNA, 19 nt, Artificial Sequence
  Description of Artificial Sequence: Synthetic oligonucleotide
gugucugguaugaggaucu

SEQ ID NO: 7556 - RNA, 19 nt, Artificial Sequence
  Description of Artificial Sequence: Synthetic oligonucleotide
agauccucauaccagacac

SEQ ID NO: 7557 - RNA, 19 nt, Artificial Sequence
  Description of Artificial Sequence: Synthetic oligonucleotide
ugucugguaugaggaucua

SEQ ID NO: 7558 - RNA, 19 nt, Artificial Sequence
  Description of Artificial Sequence: Synthetic oligonucleotide
uagauccucauaccagaca

SEQ ID NO: 7559 - RNA, 19 nt, Artificial Sequence
  Description of Artificial Sequence: Synthetic oligonucleotide
caaggguguccuacagagu

SEQ ID NO: 7560 - RNA, 19 nt, Artificial Sequence
  Description of Artificial Sequence: Synthetic oligonucleotide
acucuguaggacacccuug

SEQ ID NO: 7561 - RNA, 19 nt, Artificial Sequence
  Description of Artificial Sequence: Synthetic oligonucleotide
aaggguguccuacagagug

SEQ ID NO: 7562 - RNA, 19 nt, Artificial Sequence
  Description of Artificial Sequence: Synthetic oligonucleotide
cacucuguaggacacccuu

SEQ ID NO: 7563 - RNA, 19 nt, Artificial Sequence
  Description of Artificial Sequence: Synthetic oligonucleotide
aggguguccuacagagugg

SEQ ID NO: 7564 - RNA, 19 nt, Artificial Sequence
  Description of Artificial Sequence: Synthetic oligonucleotide
ccacucuguaggacacccu

SEQ ID NO: 7565 - RNA, 19 nt, Artificial Sequence
  Description of Artificial Sequence: Synthetic oligonucleotide
ggguguccuacagagugga

SEQ ID NO: 7566 - RNA, 19 nt, Artificial Sequence
  Description of Artificial Sequence: Synthetic oligonucleotide
uccacucuguaggacaccc

SEQ ID NO: 7567 - RNA, 19 nt, Artificial Sequence
  Description of Artificial Sequence: Synthetic oligonucleotide
gguguccuacagaguggag

SEQ ID NO: 7568 - RNA, 19 nt, Artificial Sequence
  Description of Artificial Sequence: Synthetic oligonucleotide
cuccacucuguaggacacc

SEQ ID NO: 7569 - RNA, 19 nt, Artificial Sequence
  Description of Artificial Sequence: Synthetic oligonucleotide
uccuacagaguggagugcu

SEQ ID NO: 7570 - RNA, 19 nt, Artificial Sequence
  Description of Artificial Sequence: Synthetic oligonucleotide
agcacuccacucuguagga

SEQ ID NO: 7571 - RNA, 19 nt, Artificial Sequence
  Description of Artificial Sequence: Synthetic oligonucleotide
aguggagugcugucauaug

SEQ ID NO: 7572 - RNA, 19 nt, Artificial Sequence
  Description of Artificial Sequence: Synthetic oligonucleotide
cauaugacagcacuccacu

SEQ ID NO: 7573 - RNA, 19 nt, Artificial Sequence
  Description of Artificial Sequence: Synthetic oligonucleotide
guggagugcugucauaugg

SEQ ID NO: 7574 - RNA, 19 nt, Artificial Sequence
  Description of Artificial Sequence: Synthetic oligonucleotide
ccauaugacagcacuccac

SEQ ID NO: 7575 - RNA, 19 nt, Artificial Sequence
  Description of Artificial Sequence: Synthetic oligonucleotide
uggagugcugucauauggc

SEQ ID NO: 7576 - RNA, 19 nt, Artificial Sequence
  Description of Artificial Sequence: Synthetic oligonucleotide
gccauaugacagcacucca

SEQ ID NO: 7577 - RNA, 19 nt, Artificial Sequence
  Description of Artificial Sequence: Synthetic oligonucleotide
ggagugcugucauauggcc

SEQ ID NO: 7578 - RNA, 19 nt, Artificial Sequence
  Description of Artificial Sequence: Synthetic oligonucleotide
ggccauaugacagcacucc

SEQ ID NO: 7579 - RNA, 19 nt, Artificial Sequence
  Description of Artificial Sequence: Synthetic oligonucleotide
gagugcugucauauggccu

SEQ ID NO: 7580 - RNA, 19 nt, Artificial Sequence
  Description of Artificial Sequence: Synthetic oligonucleotide
aggccauaugacagcacuc

SEQ ID NO: 7581 - RNA, 19 nt, Artificial Sequence
  Description of Artificial Sequence: Synthetic oligonucleotide
agugcugucauauggccug

SEQ ID NO: 7582 - RNA, 19 nt, Artificial Sequence
  Description of Artificial Sequence: Synthetic oligonucleotide
caggccauaugacagcacu

SEQ ID NO: 7583 - RNA, 19 nt, Artificial Sequence
  Description of Artificial Sequence: Synthetic oligonucleotide
gugcugucauauggccugg

SEQ ID NO: 7584 - RNA, 19 nt, Artificial Sequence
  Description of Artificial Sequence: Synthetic oligonucleotide
ccaggccauaugacagcac

SEQ ID NO: 7585 - RNA, 19 nt, Artificial Sequence
  Description of Artificial Sequence: Synthetic oligonucleotide
ugcugucauauggccuggg

SEQ ID NO: 7586 - RNA, 19 nt, Artificial Sequence
  Description of Artificial Sequence: Synthetic oligonucleotide
cccaggccauaugacagca

SEQ ID NO: 7587 - RNA, 19 nt, Artificial Sequence
  Description of Artificial Sequence: Synthetic oligonucleotide
gcugucauauggccuggga

SEQ ID NO: 7588 - RNA, 19 nt, Artificial Sequence
  Description of Artificial Sequence: Synthetic oligonucleotide
ucccaggccauaugacagc

SEQ ID NO: 7589 - RNA, 19 nt, Artificial Sequence
  Description of Artificial Sequence: Synthetic oligonucleotide
cugucauauggccugggac

SEQ ID NO: 7590 - RNA, 19 nt, Artificial Sequence
  Description of Artificial Sequence: Synthetic oligonucleotide
gucccaggccauaugacag

SEQ ID NO: 7591 - RNA, 19 nt, Artificial Sequence
  Description of Artificial Sequence: Synthetic oligonucleotide
ugucauauggccugggacg

SEQ ID NO: 7592 - RNA, 19 nt, Artificial Sequence
  Description of Artificial Sequence: Synthetic oligonucleotide
cgucccaggccauaugaca

SEQ ID NO: 7593 - RNA, 19 nt, Artificial Sequence
  Description of Artificial Sequence: Synthetic oligonucleotide
gucauauggccugggacgg

SEQ ID NO: 7594 - RNA, 19 nt, Artificial Sequence
  Description of Artificial Sequence: Synthetic oligonucleotide
ccgucccaggccauaugac

SEQ ID NO: 7595 - RNA, 19 nt, Artificial Sequence
  Description of Artificial Sequence: Synthetic oligonucleotide
agaggcccaagcacagcaa

SEQ ID NO: 7596 - RNA, 19 nt, Artificial Sequence
  Description of Artificial Sequence: Synthetic oligonucleotide
uugcugugcuugggccucu

SEQ ID NO: 7597 - RNA, 19 nt, Artificial Sequence
  Description of Artificial Sequence: Synthetic oligonucleotide
gaggcccaagcacagcaag

SEQ ID NO: 7598 - RNA, 19 nt, Artificial Sequence
  Description of Artificial Sequence: Synthetic oligonucleotide
cuugcugugcuugggccuc

SEQ ID NO: 7599 - RNA, 19 nt, Artificial Sequence
  Description of Artificial Sequence: Synthetic oligonucleotide
aggcccaagcacagcaagg

SEQ ID NO: 7600 - RNA, 19 nt, Artificial Sequence
  Description of Artificial Sequence: Synthetic oligonucleotide
ccuugcugugcuugggccu

SEQ ID NO: 7601 - RNA, 19 nt, Artificial Sequence
  Description of Artificial Sequence: Synthetic oligonucleotide
ggcccaagcacagcaagga

SEQ ID NO: 7602 - RNA, 19 nt, Artificial Sequence
  Description of Artificial Sequence: Synthetic oligonucleotide
uccuugcugugcuugggcc

SEQ ID NO: 7603 - RNA, 19 nt, Artificial Sequence
  Description of Artificial Sequence: Synthetic oligonucleotide
ccaagcacagcaaggacau

SEQ ID NO: 7604 - RNA, 19 nt, Artificial Sequence
  Description of Artificial Sequence: Synthetic oligonucleotide
auguccuugcugugcuugg

SEQ ID NO: 7605 - RNA, 19 nt, Artificial Sequence
  Description of Artificial Sequence: Synthetic oligonucleotide
gcccgauucaccuuugacg

SEQ ID NO: 7606 - RNA, 19 nt, Artificial Sequence
  Description of Artificial Sequence: Synthetic oligonucleotide
cgucaaaggugaaucgggc

SEQ ID NO: 7607 - RNA, 19 nt, Artificial Sequence
  Description of Artificial Sequence: Synthetic oligonucleotide
gauucaccuuugacgugua

SEQ ID NO: 7608 - RNA, 19 nt, Artificial Sequence
  Description of Artificial Sequence: Synthetic oligonucleotide
uacacgucaaaggugaauc

SEQ ID NO: 7609 - RNA, 19 nt, Artificial Sequence
  Description of Artificial Sequence: Synthetic oligonucleotide
auucaccuuugacguguac

SEQ ID NO: 7610 - RNA, 19 nt, Artificial Sequence
  Description of Artificial Sequence: Synthetic oligonucleotide
guacacgucaaaggugaau

SEQ ID NO: 7611 - RNA, 19 nt, Artificial Sequence
  Description of Artificial Sequence: Synthetic oligonucleotide
uuggcagccugaaugucaa

SEQ ID NO: 7612 - RNA, 19 nt, Artificial Sequence
  Description of Artificial Sequence: Synthetic oligonucleotide
uugacauucaggcugccaa

SEQ ID NO: 7613 - RNA, 19 nt, Artificial Sequence
  Description of Artificial Sequence: Synthetic oligonucleotide
uggcagccugaaugucaaa

SEQ ID NO: 7614 - RNA, 19 nt, Artificial Sequence
  Description of Artificial Sequence: Synthetic oligonucleotide
uuugacauucaggcugcca

SEQ ID NO: 7615 - RNA, 19 nt, Artificial Sequence
  Description of Artificial Sequence: Synthetic oligonucleotide
ggcagccugaaugucaaag

SEQ ID NO: 7616 - RNA, 19 nt, Artificial Sequence
  Description of Artificial Sequence: Synthetic oligonucleotide
cuuugacauucaggcugcc

SEQ ID NO: 7617 - RNA, 19 nt, Artificial Sequence
  Description of Artificial Sequence: Synthetic oligonucleotide
gcagccugaaugucaaagc

SEQ ID NO: 7618 - RNA, 19 nt, Artificial Sequence
  Description of Artificial Sequence: Synthetic oligonucleotide
gcuuugacauucaggcugc

SEQ ID NO: 7619 - RNA, 19 nt, Artificial Sequence
  Description of Artificial Sequence: Synthetic oligonucleotide
cagccugaaugucaaagcc

SEQ ID NO: 7620 - RNA, 19 nt, Artificial Sequence
  Description of Artificial Sequence: Synthetic oligonucleotide
ggcuuugacauucaggcug

SEQ ID NO: 7621 - RNA, 19 nt, Artificial Sequence
  Description of Artificial Sequence: Synthetic oligonucleotide
agccugaaugucaaagcca

SEQ ID NO: 7622 - RNA, 19 nt, Artificial Sequence
  Description of Artificial Sequence: Synthetic oligonucleotide
uggcuuugacauucaggcu

SEQ ID NO: 7623 - RNA, 19 nt, Artificial Sequence
  Description of Artificial Sequence: Synthetic oligonucleotide
gccugaaugucaaagccac

SEQ ID NO: 7624 - RNA, 19 nt, Artificial Sequence
  Description of Artificial Sequence: Synthetic oligonucleotide
guggcuuugacauucaggc

SEQ ID NO: 7625 - RNA, 19 nt, Artificial Sequence
  Description of Artificial Sequence: Synthetic oligonucleotide
gucaaagccacauucuacg

SEQ ID NO: 7626 - RNA, 19 nt, Artificial Sequence
  Description of Artificial Sequence: Synthetic oligonucleotide
cguagaauguggcuuugac

SEQ ID NO: 7627 - RNA, 19 nt, Artificial Sequence
  Description of Artificial Sequence: Synthetic oligonucleotide
ucaaagccacauucuacgg

SEQ ID NO: 7628 - RNA, 19 nt, Artificial Sequence
  Description of Artificial Sequence: Synthetic oligonucleotide
ccguagaauguggcuuuga

SEQ ID NO: 7629 - RNA, 19 nt, Artificial Sequence
  Description of Artificial Sequence: Synthetic oligonucleotide
caaagccacauucuacggg

SEQ ID NO: 7630 - RNA, 19 nt, Artificial Sequence
  Description of Artificial Sequence: Synthetic oligonucleotide
cccguagaauguggcuuug

SEQ ID NO: 7631 - RNA, 19 nt, Artificial Sequence
  Description of Artificial Sequence: Synthetic oligonucleotide
aaagccacauucuacgggc

SEQ ID NO: 7632 - RNA, 19 nt, Artificial Sequence
  Description of Artificial Sequence: Synthetic oligonucleotide
gcccguagaauguggcuuu

SEQ ID NO: 7633 - RNA, 19 nt, Artificial Sequence
  Description of Artificial Sequence: Synthetic oligonucleotide
gccacauucuacgggcucu

SEQ ID NO: 7634 - RNA, 19 nt, Artificial Sequence
  Description of Artificial Sequence: Synthetic oligonucleotide
agagcccguagaauguggc

SEQ ID NO: 7635 - RNA, 19 nt, Artificial Sequence
  Description of Artificial Sequence: Synthetic oligonucleotide
ccacauucuacgggcucua

SEQ ID NO: 7636 - RNA, 19 nt, Artificial Sequence
  Description of Artificial Sequence: Synthetic oligonucleotide
uagagcccguagaaugugg

SEQ ID NO: 7637 - RNA, 19 nt, Artificial Sequence
  Description of Artificial Sequence: Synthetic oligonucleotide
cacauucuacgggcucuac

SEQ ID NO: 7638 - RNA, 19 nt, Artificial Sequence
  Description of Artificial Sequence: Synthetic oligonucleotide
guagagcccguagaaugug

SEQ ID NO: 7639 - RNA, 19 nt, Artificial Sequence
  Description of Artificial Sequence: Synthetic oligonucleotide
uucuacgggcucuacucua

SEQ ID NO: 7640 - RNA, 19 nt, Artificial Sequence
  Description of Artificial Sequence: Synthetic oligonucleotide
uagaguagagcccguagaa

SEQ ID NO: 7641 - RNA, 19 nt, Artificial Sequence
  Description of Artificial Sequence: Synthetic oligonucleotide
ucuacgggcucuacucuau

SEQ ID NO: 7642 - RNA, 19 nt, Artificial Sequence
  Description of Artificial Sequence: Synthetic oligonucleotide
auagaguagagcccguaga

SEQ ID NO: 7643 - RNA, 19 nt, Artificial Sequence
  Description of Artificial Sequence: Synthetic oligonucleotide
cuacgggcucuacucuaug

SEQ ID NO: 7644 - RNA, 19 nt, Artificial Sequence
  Description of Artificial Sequence: Synthetic oligonucleotide
cauagaguagagcccguag

SEQ ID NO: 7645 - RNA, 19 nt, Artificial Sequence
  Description of Artificial Sequence: Synthetic oligonucleotide
cucuaugaguugugacuuu

SEQ ID NO: 7646 - RNA, 19 nt, Artificial Sequence
  Description of Artificial Sequence: Synthetic oligonucleotide
aaagucacaacucauagag

SEQ ID NO: 7647 - RNA, 19 nt, Artificial Sequence
  Description of Artificial Sequence: Synthetic oligonucleotide
ucuaugaguugugacuuuc

SEQ ID NO: 7648 - RNA, 19 nt, Artificial Sequence
  Description of Artificial Sequence: Synthetic oligonucleotide
gaaagucacaacucauaga

SEQ ID NO: 7649 - RNA, 19 nt, Artificial Sequence
  Description of Artificial Sequence: Synthetic oligonucleotide
ugaguugugacuuucaagg

SEQ ID NO: 7650 - RNA, 19 nt, Artificial Sequence
  Description of Artificial Sequence: Synthetic oligonucleotide
ccuugaaagucacaacuca

SEQ ID NO: 7651 - RNA, 19 nt, Artificial Sequence
  Description of Artificial Sequence: Synthetic oligonucleotide
gaguugugacuuucaagga

SEQ ID NO: 7652 - RNA, 19 nt, Artificial Sequence
  Description of Artificial Sequence: Synthetic oligonucleotide
uccuugaaagucacaacuc

SEQ ID NO: 7653 - RNA, 19 nt, Artificial Sequence
  Description of Artificial Sequence: Synthetic oligonucleotide
aguugugacuuucaaggac

SEQ ID NO: 7654 - RNA, 19 nt, Artificial Sequence
  Description of Artificial Sequence: Synthetic oligonucleotide
guccuugaaagucacaacu

SEQ ID NO: 7655 - RNA, 19 nt, Artificial Sequence
  Description of Artificial Sequence: Synthetic oligonucleotide
guugugacuuucaaggacu

SEQ ID NO: 7656 - RNA, 19 nt, Artificial Sequence
  Description of Artificial Sequence: Synthetic oligonucleotide
aguccuugaaagucacaac

SEQ ID NO: 7657 - RNA, 19 nt, Artificial Sequence
  Description of Artificial Sequence: Synthetic oligonucleotide
gacuuucaaggacuuggcc

SEQ ID NO: 7658 - RNA, 19 nt, Artificial Sequence
  Description of Artificial Sequence: Synthetic oligonucleotide
ggccaaguccuugaaaguc

SEQ ID NO: 7659 - RNA, 19 nt, Artificial Sequence
  Description of Artificial Sequence: Synthetic oligonucleotide
uuucaaggacuuggcccaa

SEQ ID NO: 7660 - RNA, 19 nt, Artificial Sequence
  Description of Artificial Sequence: Synthetic oligonucleotide
uugggccaaguccuugaaa

SEQ ID NO: 7661 - RNA, 19 nt, Artificial Sequence
  Description of Artificial Sequence: Synthetic oligonucleotide
uucaaggacuuggcccaaa

SEQ ID NO: 7662 - RNA, 19 nt, Artificial Sequence
  Description of Artificial Sequence: Synthetic oligonucleotide
uuugggccaaguccuugaa

SEQ ID NO: 7663 - RNA, 19 nt, Artificial Sequence
  Description of Artificial Sequence: Synthetic oligonucleotide
cccuacaguuggauagucc

SEQ ID NO: 7664 - RNA, 19 nt, Artificial Sequence
  Description of Artificial Sequence: Synthetic oligonucleotide
ggacuauccaacuguaggg

SEQ ID NO: 7665 - RNA, 19 nt, Artificial Sequence
  Description of Artificial Sequence: Synthetic oligonucleotide
ccuacaguuggauaguccc

SEQ ID NO: 7666 - RNA, 19 nt, Artificial Sequence
  Description of Artificial Sequence: Synthetic oligonucleotide
gggacuauccaacuguagg

SEQ ID NO: 7667 - RNA, 19 nt, Artificial Sequence
  Description of Artificial Sequence: Synthetic oligonucleotide
auucguccucuugcaccca

SEQ ID NO: 7668 - RNA, 19 nt, Artificial Sequence
  Description of Artificial Sequence: Synthetic oligonucleotide
ugggugcaagaggacgaau

SEQ ID NO: 7669 - RNA, 19 nt, Artificial Sequence
  Description of Artificial Sequence: Synthetic oligonucleotide
uucguccucuugcacccac

SEQ ID NO: 7670 - RNA, 19 nt, Artificial Sequence
  Description of Artificial Sequence: Synthetic oligonucleotide
gugggugcaagaggacgaa

SEQ ID NO: 7671 - RNA, 19 nt, Artificial Sequence
  Description of Artificial Sequence: Synthetic oligonucleotide
uccucuugcacccaccuac

SEQ ID NO: 7672 - RNA, 19 nt, Artificial Sequence
  Description of Artificial Sequence: Synthetic oligonucleotide
guaggugggugcaagagga

SEQ ID NO: 7673 - RNA, 19 nt, Artificial Sequence
  Description of Artificial Sequence: Synthetic oligonucleotide
ccucuugcacccaccuacc

SEQ ID NO: 7674 - RNA, 19 nt, Artificial Sequence
  Description of Artificial Sequence: Synthetic oligonucleotide
gguaggugggugcaagagg

SEQ ID NO: 7675 - RNA, 19 nt, Artificial Sequence
  Description of Artificial Sequence: Synthetic oligonucleotide
cucuugcacccaccuaccc

SEQ ID NO: 7676 - RNA, 19 nt, Artificial Sequence
  Description of Artificial Sequence: Synthetic oligonucleotide
ggguaggugggugcaagag

SEQ ID NO: 7677 - RNA, 19 nt, Artificial Sequence
  Description of Artificial Sequence: Synthetic oligonucleotide
cuaguuagcucuugcuugu

SEQ ID NO: 7678 - RNA, 19 nt, Artificial Sequence
  Description of Artificial Sequence: Synthetic oligonucleotide
acaagcaagagcuaacuag

SEQ ID NO: 7679 - RNA, 19 nt, Artificial Sequence
  Description of Artificial Sequence: Synthetic oligonucleotide
uaguuagcucuugcuugug

SEQ ID NO: 7680 - RNA, 19 nt, Artificial Sequence
  Description of Artificial Sequence: Synthetic oligonucleotide
cacaagcaagagcuaacua

SEQ ID NO: 7681 - RNA, 19 nt, Artificial Sequence
  Description of Artificial Sequence: Synthetic oligonucleotide
aguuagcucuugcuugugg

SEQ ID NO: 7682 - RNA, 19 nt, Artificial Sequence
  Description of Artificial Sequence: Synthetic oligonucleotide
ccacaagcaagagcuaacu

SEQ ID NO: 7683 - RNA, 19 nt, Artificial Sequence
  Description of Artificial Sequence: Synthetic oligonucleotide
uuagcucuugcuuguggaa

SEQ ID NO: 7684 - RNA, 19 nt, Artificial Sequence
  Description of Artificial Sequence: Synthetic oligonucleotide
uuccacaagcaagagcuaa

SEQ ID NO: 7685 - RNA, 19 nt, Artificial Sequence
  Description of Artificial Sequence: Synthetic oligonucleotide
uccucaucucccagcuuga

SEQ ID NO: 7686 - RNA, 19 nt, Artificial Sequence
  Description of Artificial Sequence: Synthetic oligonucleotide
ucaagcugggagaugagga

SEQ ID NO: 7687 - RNA, 19 nt, Artificial Sequence
  Description of Artificial Sequence: Synthetic oligonucleotide
aucucccagcuugauggcu

SEQ ID NO: 7688 - RNA, 19 nt, Artificial Sequence
  Description of Artificial Sequence: Synthetic oligonucleotide
agccaucaagcugggagau

SEQ ID NO: 7689 - RNA, 19 nt, Artificial Sequence
  Description of Artificial Sequence: Synthetic oligonucleotide
ucucccagcuugauggcuu

SEQ ID NO: 7690 - RNA, 19 nt, Artificial Sequence
  Description of Artificial Sequence: Synthetic oligonucleotide
aagccaucaagcugggaga

SEQ ID NO: 7691 - RNA, 19 nt, Artificial Sequence
  Description of Artificial Sequence: Synthetic oligonucleotide
cucccagcuugauggcuuc

SEQ ID NO: 7692 - RNA, 19 nt, Artificial Sequence
  Description of Artificial Sequence: Synthetic oligonucleotide
gaagccaucaagcugggag

SEQ ID NO: 7693 - RNA, 19 nt, Artificial Sequence
  Description of Artificial Sequence: Synthetic oligonucleotide
ucccagcuugauggcuucc

SEQ ID NO: 7694 - RNA, 19 nt, Artificial Sequence
  Description of Artificial Sequence: Synthetic oligonucleotide
ggaagccaucaagcuggga

SEQ ID NO: 7695 - RNA, 19 nt, Artificial Sequence
  Description of Artificial Sequence: Synthetic oligonucleotide
cccagcuugauggcuuccu

SEQ ID NO: 7696 - RNA, 19 nt, Artificial Sequence
  Description of Artificial Sequence: Synthetic oligonucleotide
aggaagccaucaagcuggg

SEQ ID NO: 7697 - RNA, 19 nt, Artificial Sequence
  Description of Artificial Sequence: Synthetic oligonucleotide
ccagcuugauggcuuccuc

SEQ ID NO: 7698 - RNA, 19 nt, Artificial Sequence
  Description of Artificial Sequence: Synthetic oligonucleotide
gaggaagccaucaagcugg

SEQ ID NO: 7699 - RNA, 19 nt, Artificial Sequence
  Description of Artificial Sequence: Synthetic oligonucleotide
ugauggcuuccucccaagu

SEQ ID NO: 7700 - RNA, 19 nt, Artificial Sequence
  Description of Artificial Sequence: Synthetic oligonucleotide
acuugggaggaagccauca

SEQ ID NO: 7701 - RNA, 19 nt, Artificial Sequence
  Description of Artificial Sequence: Synthetic oligonucleotide
gauggcuuccucccaaguu

SEQ ID NO: 7702 - RNA, 19 nt, Artificial Sequence
  Description of Artificial Sequence: Synthetic oligonucleotide
aacuugggaggaagccauc

SEQ ID NO: 7703 - RNA, 19 nt, Artificial Sequence
  Description of Artificial Sequence: Synthetic oligonucleotide
ggcuuccucccaaguuuuc

SEQ ID NO: 7704 - RNA, 19 nt, Artificial Sequence
  Description of Artificial Sequence: Synthetic oligonucleotide
gaaaacuugggaggaagcc

SEQ ID NO: 7705 - RNA, 19 nt, Artificial Sequence
  Description of Artificial Sequence: Synthetic oligonucleotide
ccucccaaguuuuccaaau

SEQ ID NO: 7706 - RNA, 19 nt, Artificial Sequence
  Description of Artificial Sequence: Synthetic oligonucleotide
auuuggaaaacuugggagg

SEQ ID NO: 7707 - RNA, 19 nt, Artificial Sequence
  Description of Artificial Sequence: Synthetic oligonucleotide
cccaaguuuuccaaaucau

SEQ ID NO: 7708 - RNA, 19 nt, Artificial Sequence
  Description of Artificial Sequence: Synthetic oligonucleotide
augauuuggaaaacuuggg

SEQ ID NO: 7709 - RNA, 19 nt, Artificial Sequence
  Description of Artificial Sequence: Synthetic oligonucleotide
ccaaguuuuccaaaucauc

SEQ ID NO: 7710 - RNA, 19 nt, Artificial Sequence
  Description of Artificial Sequence: Synthetic oligonucleotide
gaugauuuggaaaacuugg

SEQ ID NO: 7711 - RNA, 19 nt, Artificial Sequence
  Description of Artificial Sequence: Synthetic oligonucleotide
caaguuuuccaaaucaucu

SEQ ID NO: 7712 - RNA, 19 nt, Artificial Sequence
  Description of Artificial Sequence: Synthetic oligonucleotide
agaugauuuggaaaacuug

SEQ ID NO: 7713 - RNA, 19 nt, Artificial Sequence
  Description of Artificial Sequence: Synthetic oligonucleotide
aaguuuuccaaaucaucug

SEQ ID NO: 7714 - RNA, 19 nt, Artificial Sequence
  Description of Artificial Sequence: Synthetic oligonucleotide
cagaugauuuggaaaacuu

SEQ ID NO: 7715 - RNA, 19 nt, Artificial Sequence
  Description of Artificial Sequence: Synthetic oligonucleotide
guuuuccaaaucaucugau

SEQ ID NO: 7716 - RNA, 19 nt, Artificial Sequence
  Description of Artificial Sequence: Synthetic oligonucleotide
aucagaugauuuggaaaac

SEQ ID NO: 7717 - RNA, 19 nt, Artificial Sequence
  Description of Artificial Sequence: Synthetic oligonucleotide
aucugauuuccucuugucu

SEQ ID NO: 7718 - RNA, 19 nt, Artificial Sequence
  Description of Artificial Sequence: Synthetic oligonucleotide
agacaagaggaaaucagau

SEQ ID NO: 7719 - RNA, 19 nt, Artificial Sequence
  Description of Artificial Sequence: Synthetic oligonucleotide
ucugauuuccucuugucuc

SEQ ID NO: 7720 - RNA, 19 nt, Artificial Sequence
  Description of Artificial Sequence: Synthetic oligonucleotide
gagacaagaggaaaucaga

SEQ ID NO: 7721 - RNA, 19 nt, Artificial Sequence
  Description of Artificial Sequence: Synthetic oligonucleotide
cugauuuccucuugucucu

SEQ ID NO: 7722 - RNA, 19 nt, Artificial Sequence
  Description of Artificial Sequence: Synthetic oligonucleotide
agagacaagaggaaaucag

SEQ ID NO: 7723 - RNA, 19 nt, Artificial Sequence
  Description of Artificial Sequence: Synthetic oligonucleotide
cucuugucucugccauuca

SEQ ID NO: 7724 - RNA, 19 nt, Artificial Sequence
  Description of Artificial Sequence: Synthetic oligonucleotide
ugaauggcagagacaagag

SEQ ID NO: 7725 - RNA, 19 nt, Artificial Sequence
  Description of Artificial Sequence: Synthetic oligonucleotide
guuggaccuccacacugcu

SEQ ID NO: 7726 - RNA, 19 nt, Artificial Sequence
  Description of Artificial Sequence: Synthetic oligonucleotide
agcaguguggagguccaac

SEQ ID NO: 7727 - RNA, 19 nt, Artificial Sequence
  Description of Artificial Sequence: Synthetic oligonucleotide
ccacacugcugcaaggccu

SEQ ID NO: 7728 - RNA, 19 nt, Artificial Sequence
  Description of Artificial Sequence: Synthetic oligonucleotide
aggccuugcagcagugugg

SEQ ID NO: 7729 - RNA, 19 nt, Artificial Sequence
  Description of Artificial Sequence: Synthetic oligonucleotide
cacacugcugcaaggccug

SEQ ID NO: 7730 - RNA, 19 nt, Artificial Sequence
  Description of Artificial Sequence: Synthetic oligonucleotide
caggccuugcagcagugug

SEQ ID NO: 7731 - RNA, 19 nt, Artificial Sequence
  Description of Artificial Sequence: Synthetic oligonucleotide
acacugcugcaaggccugg

SEQ ID NO: 7732 - RNA, 19 nt, Artificial Sequence
  Description of Artificial Sequence: Synthetic oligonucleotide
ccaggccuugcagcagugu

SEQ ID NO: 7733 - RNA, 19 nt, Artificial Sequence
  Description of Artificial Sequence: Synthetic oligonucleotide
ugcaaggccugggccauau

SEQ ID NO: 7734 - RNA, 19 nt, Artificial Sequence
  Description of Artificial Sequence: Synthetic oligonucleotide
auauggcccaggccuugca

SEQ ID NO: 7735 - RNA, 19 nt, Artificial Sequence
  Description of Artificial Sequence: Synthetic oligonucleotide
gcaaggccugggccauaug

SEQ ID NO: 7736 - RNA, 19 nt, Artificial Sequence
  Description of Artificial Sequence: Synthetic oligonucleotide
cauauggcccaggccuugc

SEQ ID NO: 7737 - RNA, 19 nt, Artificial Sequence
  Description of Artificial Sequence: Synthetic oligonucleotide
caaggccugggccauaugu

SEQ ID NO: 7738 - RNA, 19 nt, Artificial Sequence
  Description of Artificial Sequence: Synthetic oligonucleotide
acauauggcccaggccuug

SEQ ID NO: 7739 - RNA, 19 nt, Artificial Sequence
  Description of Artificial Sequence: Synthetic oligonucleotide
aaggccugggccauauguu

SEQ ID NO: 7740 - RNA, 19 nt, Artificial Sequence
  Description of Artificial Sequence: Synthetic oligonucleotide
aacauauggcccaggccuu

SEQ ID NO: 7741 - RNA, 19 nt, Artificial Sequence
  Description of Artificial Sequence: Synthetic oligonucleotide
aggccugggccauauguug

SEQ ID NO: 7742 - RNA, 19 nt, Artificial Sequence
  Description of Artificial Sequence: Synthetic oligonucleotide
caacauauggcccaggccu

SEQ ID NO: 7743 - RNA, 19 nt, Artificial Sequence
  Description of Artificial Sequence: Synthetic oligonucleotide
ggccugggccauauguugc

SEQ ID NO: 7744 - RNA, 19 nt, Artificial Sequence
  Description of Artificial Sequence: Synthetic oligonucleotide
gcaacauauggcccaggcc

SEQ ID NO: 7745 - RNA, 19 nt, Artificial Sequence
  Description of Artificial Sequence: Synthetic oligonucleotide
gccugggccauauguugcu

SEQ ID NO: 7746 - RNA, 19 nt, Artificial Sequence
  Description of Artificial Sequence: Synthetic oligonucleotide
agcaacauauggcccaggc

SEQ ID NO: 7747 - RNA, 19 nt, Artificial Sequence
  Description of Artificial Sequence: Synthetic oligonucleotide
ccugggccauauguugcug

SEQ ID NO: 7748 - RNA, 19 nt, Artificial Sequence
  Description of Artificial Sequence: Synthetic oligonucleotide
cagcaacauauggcccagg

SEQ ID NO: 7749 - RNA, 19 nt, Artificial Sequence
  Description of Artificial Sequence: Synthetic oligonucleotide
ggccauauguugcugggaa

SEQ ID NO: 7750 - RNA, 19 nt, Artificial Sequence
  Description of Artificial Sequence: Synthetic oligonucleotide
uucccagcaacauauggcc

SEQ ID NO: 7751 - RNA, 19 nt, Artificial Sequence
  Description of Artificial Sequence: Synthetic oligonucleotide
ccauauguugcugggaauu

SEQ ID NO: 7752 - RNA, 19 nt, Artificial Sequence
  Description of Artificial Sequence: Synthetic oligonucleotide
aauucccagcaacauaugg

SEQ ID NO: 7753 - RNA, 19 nt, Artificial Sequence
  Description of Artificial Sequence: Synthetic oligonucleotide
ggaauuuccuccacccuuc

SEQ ID NO: 7754 - RNA, 19 nt, Artificial Sequence
  Description of Artificial Sequence: Synthetic oligonucleotide
gaaggguggaggaaauucc

SEQ ID NO: 7755 - RNA, 19 nt, Artificial Sequence
  Description of Artificial Sequence: Synthetic oligonucleotide
gaauuuccuccacccuucg

SEQ ID NO: 7756 - RNA, 19 nt, Artificial Sequence
  Description of Artificial Sequence: Synthetic oligonucleotide
cgaaggguggaggaaauuc

SEQ ID NO: 7757 - RNA, 19 nt, Artificial Sequence
  Description of Artificial Sequence: Synthetic oligonucleotide
aauuuccuccacccuucgu

SEQ ID NO: 7758 - RNA, 19 nt, Artificial Sequence
  Description of Artificial Sequence: Synthetic oligonucleotide
acgaaggguggaggaaauu

SEQ ID NO: 7759 - RNA, 19 nt, Artificial Sequence
  Description of Artificial Sequence: Synthetic oligonucleotide
auuuccuccacccuucguc

SEQ ID NO: 7760 - RNA, 19 nt, Artificial Sequence
  Description of Artificial Sequence: Synthetic oligonucleotide
gacgaaggguggaggaaau

SEQ ID NO: 7761 - RNA, 19 nt, Artificial Sequence
  Description of Artificial Sequence: Synthetic oligonucleotide
uuuccuccacccuucguca

SEQ ID NO: 7762 - RNA, 19 nt, Artificial Sequence
  Description of Artificial Sequence: Synthetic oligonucleotide
ugacgaaggguggaggaaa

SEQ ID NO: 7763 - RNA, 19 nt, Artificial Sequence
  Description of Artificial Sequence: Synthetic oligonucleotide
uuccuccacccuucgucau

SEQ ID NO: 7764 - RNA, 19 nt, Artificial Sequence
  Description of Artificial Sequence: Synthetic oligonucleotide
augacgaaggguggaggaa

SEQ ID NO: 7765 - RNA, 19 nt, Artificial Sequence
  Description of Artificial Sequence: Synthetic oligonucleotide
uccuccacccuucgucaug

SEQ ID NO: 7766 - RNA, 19 nt, Artificial Sequence
  Description of Artificial Sequence: Synthetic oligonucleotide
caugacgaaggguggagga

SEQ ID NO: 7767 - RNA, 19 nt, Artificial Sequence
  Description of Artificial Sequence: Synthetic oligonucleotide
ccuccacccuucgucaugc

SEQ ID NO: 7768 - RNA, 19 nt, Artificial Sequence
  Description of Artificial Sequence: Synthetic oligonucleotide
gcaugacgaaggguggagg

SEQ ID NO: 7769 - RNA, 19 nt, Artificial Sequence
  Description of Artificial Sequence: Synthetic oligonucleotide
cuccacccuucgucaugca

SEQ ID NO: 7770 - RNA, 19 nt, Artificial Sequence
  Description of Artificial Sequence: Synthetic oligonucleotide
ugcaugacgaaggguggag

SEQ ID NO: 7771 - RNA, 19 nt, Artificial Sequence
  Description of Artificial Sequence: Synthetic oligonucleotide
ccuucgucaugcaguggag

SEQ ID NO: 7772 - RNA, 19 nt, Artificial Sequence
  Description of Artificial Sequence: Synthetic oligonucleotide
cuccacugcaugacgaagg

SEQ ID NO: 7773 - RNA, 19 nt, Artificial Sequence
  Description of Artificial Sequence: Synthetic oligonucleotide
cuucgucaugcaguggagg

SEQ ID NO: 7774 - RNA, 19 nt, Artificial Sequence
  Description of Artificial Sequence: Synthetic oligonucleotide
ccuccacugcaugacgaag

SEQ ID NO: 7775 - RNA, 19 nt, Artificial Sequence
  Description of Artificial Sequence: Synthetic oligonucleotide
uucgucaugcaguggaggg

SEQ ID NO: 7776 - RNA, 19 nt, Artificial Sequence
  Description of Artificial Sequence: Synthetic oligonucleotide
cccuccacugcaugacgaa

SEQ ID NO: 7777 - RNA, 19 nt, Artificial Sequence
  Description of Artificial Sequence: Synthetic oligonucleotide
cgccuccauuccuacuaag

SEQ ID NO: 7778 - RNA, 19 nt, Artificial Sequence
  Description of Artificial Sequence: Synthetic oligonucleotide
cuuaguaggaauggaggcg

SEQ ID NO: 7779 - RNA, 19 nt, Artificial Sequence
  Description of Artificial Sequence: Synthetic oligonucleotide
gccuccauuccuacuaagg

SEQ ID NO: 7780 - RNA, 19 nt, Artificial Sequence
  Description of Artificial Sequence: Synthetic oligonucleotide
ccuuaguaggaauggaggc

SEQ ID NO: 7781 - RNA, 19 nt, Artificial Sequence
  Description of Artificial Sequence: Synthetic oligonucleotide
ccuccauuccuacuaaggg

SEQ ID NO: 7782 - RNA, 19 nt, Artificial Sequence
  Description of Artificial Sequence: Synthetic oligonucleotide
cccuuaguaggaauggagg

SEQ ID NO: 7783 - RNA, 19 nt, Artificial Sequence
  Description of Artificial Sequence: Synthetic oligonucleotide
cagaaucauuccaaccgac

SEQ ID NO: 7784 - RNA, 19 nt, Artificial Sequence
  Description of Artificial Sequence: Synthetic oligonucleotide
gucgguuggaaugauucug

SEQ ID NO: 7785 - RNA, 19 nt, Artificial Sequence
  Description of Artificial Sequence: Synthetic oligonucleotide
agaaucauuccaaccgacc

SEQ ID NO: 7786 - RNA, 19 nt, Artificial Sequence
  Description of Artificial Sequence: Synthetic oligonucleotide
ggucgguuggaaugauucu

SEQ ID NO: 7787 - RNA, 19 nt, Artificial Sequence
  Description of Artificial Sequence: Synthetic oligonucleotide
gaaucauuccaaccgaccc

SEQ ID NO: 7788 - RNA, 19 nt, Artificial Sequence
  Description of Artificial Sequence: Synthetic oligonucleotide
gggucgguuggaaugauuc

SEQ ID NO: 7789 - RNA, 19 nt, Artificial Sequence
  Description of Artificial Sequence: Synthetic oligonucleotide
aaucauuccaaccgaccca

SEQ ID NO: 7790 - RNA, 19 nt, Artificial Sequence
  Description of Artificial Sequence: Synthetic oligonucleotide
ugggucgguuggaaugauu

SEQ ID NO: 7791 - RNA, 19 nt, Artificial Sequence
  Description of Artificial Sequence: Synthetic oligonucleotide
aucauuccaaccgacccac

SEQ ID NO: 7792 - RNA, 19 nt, Artificial Sequence
  Description of Artificial Sequence: Synthetic oligonucleotide
gugggucgguuggaaugau

SEQ ID NO: 7793 - RNA, 19 nt, Artificial Sequence
  Description of Artificial Sequence: Synthetic oligonucleotide
ucauuccaaccgacccacu

SEQ ID NO: 7794 - RNA, 19 nt, Artificial Sequence
  Description of Artificial Sequence: Synthetic oligonucleotide
agugggucgguuggaauga

SEQ ID NO: 7795 - RNA, 19 nt, Artificial Sequence
  Description of Artificial Sequence: Synthetic oligonucleotide
uccaaccgacccacugcaa

SEQ ID NO: 7796 - RNA, 19 nt, Artificial Sequence
  Description of Artificial Sequence: Synthetic oligonucleotide
uugcagugggucgguugga

SEQ ID NO: 7797 - RNA, 19 nt, Artificial Sequence
  Description of Artificial Sequence: Synthetic oligonucleotide
ccaaccgacccacugcaaa

SEQ ID NO: 7798 - RNA, 19 nt, Artificial Sequence
  Description of Artificial Sequence: Synthetic oligonucleotide
uuugcagugggucgguugg

SEQ ID NO: 7799 - RNA, 19 nt, Artificial Sequence
  Description of Artificial Sequence: Synthetic oligonucleotide
caaccgacccacugcaaag

SEQ ID NO: 7800 - RNA, 19 nt, Artificial Sequence
  Description of Artificial Sequence: Synthetic oligonucleotide
cuuugcagugggucgguug

SEQ ID NO: 7801 - RNA, 19 nt, Artificial Sequence
  Description of Artificial Sequence: Synthetic oligonucleotide
aaccgacccacugcaaaga

SEQ ID NO: 7802 - RNA, 19 nt, Artificial Sequence
  Description of Artificial Sequence: Synthetic oligonucleotide
ucuuugcagugggucgguu

SEQ ID NO: 7803 - RNA, 19 nt, Artificial Sequence
  Description of Artificial Sequence: Synthetic oligonucleotide
accgacccacugcaaagac

SEQ ID NO: 7804 - RNA, 19 nt, Artificial Sequence
  Description of Artificial Sequence: Synthetic oligonucleotide
gucuuugcagugggucggu

SEQ ID NO: 7805 - RNA, 19 nt, Artificial Sequence
  Description of Artificial Sequence: Synthetic oligonucleotide
ccgacccacugcaaagacu

SEQ ID NO: 7806 - RNA, 19 nt, Artificial Sequence
  Description of Artificial Sequence: Synthetic oligonucleotide
agucuuugcagugggucgg

SEQ ID NO: 7807 - RNA, 19 nt, Artificial Sequence
  Description of Artificial Sequence: Synthetic oligonucleotide
cgacccacugcaaagacua

SEQ ID NO: 7808 - RNA, 19 nt, Artificial Sequence
  Description of Artificial Sequence: Synthetic oligonucleotide
uagucuuugcagugggucg

SEQ ID NO: 7809 - RNA, 19 nt, Artificial Sequence
  Description of Artificial Sequence: Synthetic oligonucleotide
gacccacugcaaagacuau

SEQ ID NO: 7810 - RNA, 19 nt, Artificial Sequence
  Description of Artificial Sequence: Synthetic oligonucleotide
auagucuuugcaguggguc

SEQ ID NO: 7811 - RNA, 19 nt, Artificial Sequence
  Description of Artificial Sequence: Synthetic oligonucleotide
acccacugcaaagacuaug

SEQ ID NO: 7812 - RNA, 19 nt, Artificial Sequence
  Description of Artificial Sequence: Synthetic oligonucleotide
cauagucuuugcagugggu

SEQ ID NO: 7813 - RNA, 19 nt, Artificial Sequence
  Description of Artificial Sequence: Synthetic oligonucleotide
acugcaaagacuaugacag

SEQ ID NO: 7814 - RNA, 19 nt, Artificial Sequence
  Description of Artificial Sequence: Synthetic oligonucleotide
cugucauagucuuugcagu

SEQ ID NO: 7815 - RNA, 19 nt, Artificial Sequence
  Description of Artificial Sequence: Synthetic oligonucleotide
cugcaaagacuaugacagc

SEQ ID NO: 7816 - RNA, 19 nt, Artificial Sequence
  Description of Artificial Sequence: Synthetic oligonucleotide
gcugucauagucuuugcag

SEQ ID NO: 7817 - RNA, 19 nt, Artificial Sequence
  Description of Artificial Sequence: Synthetic oligonucleotide
ugcaaagacuaugacagca

SEQ ID NO: 7818 - RNA, 19 nt, Artificial Sequence
  Description of Artificial Sequence: Synthetic oligonucleotide
ugcugucauagucuuugca

SEQ ID NO: 7819 - RNA, 19 nt, Artificial Sequence
  Description of Artificial Sequence: Synthetic oligonucleotide
gcaaagacuaugacagcau

SEQ ID NO: 7820 - RNA, 19 nt, Artificial Sequence
  Description of Artificial Sequence: Synthetic oligonucleotide
augcugucauagucuuugc

SEQ ID NO: 7821 - RNA, 19 nt, Artificial Sequence
  Description of Artificial Sequence: Synthetic oligonucleotide
aaagacuaugacagcauca

SEQ ID NO: 7822 - RNA, 19 nt, Artificial Sequence
  Description of Artificial Sequence: Synthetic oligonucleotide
ugaugcugucauagucuuu

SEQ ID NO: 7823 - RNA, 19 nt, Artificial Sequence
  Description of Artificial Sequence: Synthetic oligonucleotide
aagacuaugacagcaucaa

SEQ ID NO: 7824 - RNA, 19 nt, Artificial Sequence
  Description of Artificial Sequence: Synthetic oligonucleotide
uugaugcugucauagucuu

SEQ ID NO: 7825 - RNA, 19 nt, Artificial Sequence
  Description of Artificial Sequence: Synthetic oligonucleotide
agacuaugacagcaucaaa

SEQ ID NO: 7826 - RNA, 19 nt, Artificial Sequence
  Description of Artificial Sequence: Synthetic oligonucleotide
uuugaugcugucauagucu

SEQ ID NO: 7827 - RNA, 19 nt, Artificial Sequence
  Description of Artificial Sequence: Synthetic oligonucleotide
gacuaugacagcaucaaau

SEQ ID NO: 7828 - RNA, 19 nt, Artificial Sequence
  Description of Artificial Sequence: Synthetic oligonucleotide
auuugaugcugucauaguc

SEQ ID NO: 7829 - RNA, 19 nt, Artificial Sequence
  Description of Artificial Sequence: Synthetic oligonucleotide
cuaugacagcaucaaauuu

SEQ ID NO: 7830 - RNA, 19 nt, Artificial Sequence
  Description of Artificial Sequence: Synthetic oligonucleotide
aaauuugaugcugucauag

SEQ ID NO: 7831 - RNA, 19 nt, Artificial Sequence
  Description of Artificial Sequence: Synthetic oligonucleotide
uaugacagcaucaaauuuc

SEQ ID NO: 7832 - RNA, 19 nt, Artificial Sequence
  Description of Artificial Sequence: Synthetic oligonucleotide
gaaauuugaugcugucaua

SEQ ID NO: 7833 - RNA, 19 nt, Artificial Sequence
  Description of Artificial Sequence: Synthetic oligonucleotide
gcaucaaauuucaggaccu

SEQ ID NO: 7834 - RNA, 19 nt, Artificial Sequence
  Description of Artificial Sequence: Synthetic oligonucleotide
agguccugaaauuugaugc

SEQ ID NO: 7835 - RNA, 19 nt, Artificial Sequence
  Description of Artificial Sequence: Synthetic oligonucleotide
aucaaauuucaggaccugc

SEQ ID NO: 7836 - RNA, 19 nt, Artificial Sequence
  Description of Artificial Sequence: Synthetic oligonucleotide
gcagguccugaaauuugau

SEQ ID NO: 7837 - RNA, 19 nt, Artificial Sequence
  Description of Artificial Sequence: Synthetic oligonucleotide
ucaaauuucaggaccugca

SEQ ID NO: 7838 - RNA, 19 nt, Artificial Sequence
  Description of Artificial Sequence: Synthetic oligonucleotide
ugcagguccugaaauuuga

SEQ ID NO: 7839 - RNA, 19 nt, Artificial Sequence
  Description of Artificial Sequence: Synthetic oligonucleotide
uucaggaccugcagacagu

SEQ ID NO: 7840 - RNA, 19 nt, Artificial Sequence
  Description of Artificial Sequence: Synthetic oligonucleotide
acugucugcagguccugaa

SEQ ID NO: 7841 - RNA, 19 nt, Artificial Sequence
  Description of Artificial Sequence: Synthetic oligonucleotide
ucaggaccugcagacagua

SEQ ID NO: 7842 - RNA, 19 nt, Artificial Sequence
  Description of Artificial Sequence: Synthetic oligonucleotide
uacugucugcagguccuga

SEQ ID NO: 7843 - RNA, 19 nt, Artificial Sequence
  Description of Artificial Sequence: Synthetic oligonucleotide
caggaccugcagacaguac

SEQ ID NO: 7844 - RNA, 19 nt, Artificial Sequence
  Description of Artificial Sequence: Synthetic oligonucleotide
guacugucugcagguccug

SEQ ID NO: 7845 - RNA, 19 nt, Artificial Sequence
  Description of Artificial Sequence: Synthetic oligonucleotide
aggaccugcagacaguaca

SEQ ID NO: 7846 - RNA, 19 nt, Artificial Sequence
  Description of Artificial Sequence: Synthetic oligonucleotide
uguacugucugcagguccu

SEQ ID NO: 7847 - RNA, 19 nt, Artificial Sequence
  Description of Artificial Sequence: Synthetic oligonucleotide
ggaccugcagacaguacag

SEQ ID NO: 7848 - RNA, 19 nt, Artificial Sequence
  Description of Artificial Sequence: Synthetic oligonucleotide
cuguacugucugcaggucc

SEQ ID NO: 7849 - RNA, 19 nt, Artificial Sequence
  Description of Artificial Sequence: Synthetic oligonucleotide
cugcagacaguacaggcua

SEQ ID NO: 7850 - RNA, 19 nt, Artificial Sequence
  Description of Artificial Sequence: Synthetic oligonucleotide
uagccuguacugucugcag

SEQ ID NO: 7851 - RNA, 19 nt, Artificial Sequence
  Description of Artificial Sequence: Synthetic oligonucleotide
gacaguacaggcuagauaa

SEQ ID NO: 7852 - RNA, 19 nt, Artificial Sequence
  Description of Artificial Sequence: Synthetic oligonucleotide
uuaucuagccuguacuguc

SEQ ID NO: 7853 - RNA, 19 nt, Artificial Sequence
  Description of Artificial Sequence: Synthetic oligonucleotide
acaguacaggcuagauaac

SEQ ID NO: 7854 - RNA, 19 nt, Artificial Sequence
  Description of Artificial Sequence: Synthetic oligonucleotide
guuaucuagccuguacugu

SEQ ID NO: 7855 - RNA, 19 nt, Artificial Sequence
  Description of Artificial Sequence: Synthetic oligonucleotide
caguacaggcuagauaacc

SEQ ID NO: 7856 - RNA, 19 nt, Artificial Sequence
  Description of Artificial Sequence: Synthetic oligonucleotide
gguuaucuagccuguacug

SEQ ID NO: 7857 - RNA, 19 nt, Artificial Sequence
  Description of Artificial Sequence: Synthetic oligonucleotide
aguacaggcuagauaaccc

SEQ ID NO: 7858 - RNA, 19 nt, Artificial Sequence
  Description of Artificial Sequence: Synthetic oligonucleotide
ggguuaucuagccuguacu

SEQ ID NO: 7859 - RNA, 19 nt, Artificial Sequence
  Description of Artificial Sequence: Synthetic oligonucleotide
guacaggcuagauaaccca

SEQ ID NO: 7860 - RNA, 19 nt, Artificial Sequence
  Description of Artificial Sequence: Synthetic oligonucleotide
uggguuaucuagccuguac

SEQ ID NO: 7861 - RNA, 19 nt, Artificial Sequence
  Description of Artificial Sequence: Synthetic oligonucleotide
uacaggcuagauaacccac

SEQ ID NO: 7862 - RNA, 19 nt, Artificial Sequence
  Description of Artificial Sequence: Synthetic oligonucleotide
guggguuaucuagccugua

SEQ ID NO: 7863 - RNA, 19 nt, Artificial Sequence
  Description of Artificial Sequence: Synthetic oligonucleotide
gcuagauaacccacccaau

SEQ ID NO: 7864 - RNA, 19 nt, Artificial Sequence
  Description of Artificial Sequence: Synthetic oligonucleotide
auuggguggguuaucuagc

SEQ ID NO: 7865 - RNA, 19 nt, Artificial Sequence
  Description of Artificial Sequence: Synthetic oligonucleotide
cuagauaacccacccaauu

SEQ ID NO: 7866 - RNA, 19 nt, Artificial Sequence
  Description of Artificial Sequence: Synthetic oligonucleotide
aauuggguggguuaucuag

SEQ ID NO: 7867 - RNA, 19 nt, Artificial Sequence
  Description of Artificial Sequence: Synthetic oligonucleotide
agauaacccacccaauuuc

SEQ ID NO: 7868 - RNA, 19 nt, Artificial Sequence
  Description of Artificial Sequence: Synthetic oligonucleotide
gaaauuggguggguuaucu

SEQ ID NO: 7869 - RNA, 19 nt, Artificial Sequence
  Description of Artificial Sequence: Synthetic oligonucleotide
gauaacccacccaauuucc

SEQ ID NO: 7870 - RNA, 19 nt, Artificial Sequence
  Description of Artificial Sequence: Synthetic oligonucleotide
ggaaauuggguggguuauc

SEQ ID NO: 7871 - RNA, 19 nt, Artificial Sequence
  Description of Artificial Sequence: Synthetic oligonucleotide
aaccuuucagcauaacgcc

SEQ ID NO: 7872 - RNA, 19 nt, Artificial Sequence
  Description of Artificial Sequence: Synthetic oligonucleotide
ggcguuaugcugaaagguu

SEQ ID NO: 7873 - RNA, 19 nt, Artificial Sequence
  Description of Artificial Sequence: Synthetic oligonucleotide
accuuucagcauaacgccu

SEQ ID NO: 7874 - RNA, 19 nt, Artificial Sequence
  Description of Artificial Sequence: Synthetic oligonucleotide
aggcguuaugcugaaaggu

SEQ ID NO: 7875 - RNA, 19 nt, Artificial Sequence
  Description of Artificial Sequence: Synthetic oligonucleotide
ccuuucagcauaacgccuc

SEQ ID NO: 7876 - RNA, 19 nt, Artificial Sequence
  Description of Artificial Sequence: Synthetic oligonucleotide
gaggcguuaugcugaaagg

SEQ ID NO: 7877 - RNA, 19 nt, Artificial Sequence
  Description of Artificial Sequence: Synthetic oligonucleotide
cuuucagcauaacgccuca

SEQ ID NO: 7878 - RNA, 19 nt, Artificial Sequence
  Description of Artificial Sequence: Synthetic oligonucleotide
ugaggcguuaugcugaaag

SEQ ID NO: 7879 - RNA, 19 nt, Artificial Sequence
  Description of Artificial Sequence: Synthetic oligonucleotide
uuucagcauaacgccucac

SEQ ID NO: 7880 - RNA, 19 nt, Artificial Sequence
  Description of Artificial Sequence: Synthetic oligonucleotide
gugaggcguuaugcugaaa

SEQ ID NO: 7881 - RNA, 19 nt, Artificial Sequence
  Description of Artificial Sequence: Synthetic oligonucleotide
uucagcauaacgccucaca

SEQ ID NO: 7882 - RNA, 19 nt, Artificial Sequence
  Description of Artificial Sequence: Synthetic oligonucleotide
ugugaggcguuaugcugaa

SEQ ID NO: 7883 - RNA, 19 nt, Artificial Sequence
  Description of Artificial Sequence: Synthetic oligonucleotide
ucagcauaacgccucacau

SEQ ID NO: 7884 - RNA, 19 nt, Artificial Sequence
  Description of Artificial Sequence: Synthetic oligonucleotide
augugaggcguuaugcuga

SEQ ID NO: 7885 - RNA, 19 nt, Artificial Sequence
  Description of Artificial Sequence: Synthetic oligonucleotide
cagcauaacgccucacauc

SEQ ID NO: 7886 - RNA, 19 nt, Artificial Sequence
  Description of Artificial Sequence: Synthetic oligonucleotide
gaugugaggcguuaugcug

SEQ ID NO: 7887 - RNA, 19 nt, Artificial Sequence
  Description of Artificial Sequence: Synthetic oligonucleotide
agcauaacgccucacaucc

SEQ ID NO: 7888 - RNA, 19 nt, Artificial Sequence
  Description of Artificial Sequence: Synthetic oligonucleotide
ggaugugaggcguuaugcu

SEQ ID NO: 7889 - RNA, 19 nt, Artificial Sequence
  Description of Artificial Sequence: Synthetic oligonucleotide
gcauaacgccucacauccc

SEQ ID NO: 7890 - RNA, 19 nt, Artificial Sequence
  Description of Artificial Sequence: Synthetic oligonucleotide
gggaugugaggcguuaugc

SEQ ID NO: 7891 - RNA, 19 nt, Artificial Sequence
  Description of Artificial Sequence: Synthetic oligonucleotide
aacgccucacaucccaagu

SEQ ID NO: 7892 - RNA, 19 nt, Artificial Sequence
  Description of Artificial Sequence: Synthetic oligonucleotide
acuugggaugugaggcguu

SEQ ID NO: 7893 - RNA, 19 nt, Artificial Sequence
  Description of Artificial Sequence: Synthetic oligonucleotide
acgccucacaucccaaguc

SEQ ID NO: 7894 - RNA, 19 nt, Artificial Sequence
  Description of Artificial Sequence: Synthetic oligonucleotide
gacuugggaugugaggcgu

SEQ ID NO: 7895 - RNA, 19 nt, Artificial Sequence
  Description of Artificial Sequence: Synthetic oligonucleotide
cgccucacaucccaagucu

SEQ ID NO: 7896 - RNA, 19 nt, Artificial Sequence
  Description of Artificial Sequence: Synthetic oligonucleotide
agacuugggaugugaggcg

SEQ ID NO: 7897 - RNA, 19 nt, Artificial Sequence
  Description of Artificial Sequence: Synthetic oligonucleotide
ucacaucccaagucuauac

SEQ ID NO: 7898 - RNA, 19 nt, Artificial Sequence
  Description of Artificial Sequence: Synthetic oligonucleotide
guauagacuugggauguga

SEQ ID NO: 7899 - RNA, 19 nt, Artificial Sequence
  Description of Artificial Sequence: Synthetic oligonucleotide
cacaucccaagucuauacc

SEQ ID NO: 7900 - RNA, 19 nt, Artificial Sequence
  Description of Artificial Sequence: Synthetic oligonucleotide
gguauagacuugggaugug

SEQ ID NO: 7901 - RNA, 19 nt, Artificial Sequence
  Description of Artificial Sequence: Synthetic oligonucleotide
acaucccaagucuauaccc

SEQ ID NO: 7902 - RNA, 19 nt, Artificial Sequence
  Description of Artificial Sequence: Synthetic oligonucleotide
ggguauagacuugggaugu

SEQ ID NO: 7903 - RNA, 19 nt, Artificial Sequence
  Description of Artificial Sequence: Synthetic oligonucleotide
caucccaagucuauacccu

SEQ ID NO: 7904 - RNA, 19 nt, Artificial Sequence
  Description of Artificial Sequence: Synthetic oligonucleotide
aggguauagacuugggaug

SEQ ID NO: 7905 - RNA, 19 nt, Artificial Sequence
  Description of Artificial Sequence: Synthetic oligonucleotide
aaugcuguucuuuccuagc

SEQ ID NO: 7906 - RNA, 19 nt, Artificial Sequence
  Description of Artificial Sequence: Synthetic oligonucleotide
gcuaggaaagaacagcauu

SEQ ID NO: 7907 - RNA, 19 nt, Artificial Sequence
  Description of Artificial Sequence: Synthetic oligonucleotide
augcuguucuuuccuagcc

SEQ ID NO: 7908 - RNA, 19 nt, Artificial Sequence
  Description of Artificial Sequence: Synthetic oligonucleotide
ggcuaggaaagaacagcau

SEQ ID NO: 7909 - RNA, 19 nt, Artificial Sequence
  Description of Artificial Sequence: Synthetic oligonucleotide
cuguucuuuccuagccacc

SEQ ID NO: 7910 - RNA, 19 nt, Artificial Sequence
  Description of Artificial Sequence: Synthetic oligonucleotide
gguggcuaggaaagaacag

SEQ ID NO: 7911 - RNA, 19 nt, Artificial Sequence
  Description of Artificial Sequence: Synthetic oligonucleotide
uguucuuuccuagccaccu

SEQ ID NO: 7912 - RNA, 19 nt, Artificial Sequence
  Description of Artificial Sequence: Synthetic oligonucleotide
agguggcuaggaaagaaca

SEQ ID NO: 7913 - RNA, 19 nt, Artificial Sequence
  Description of Artificial Sequence: Synthetic oligonucleotide
gccaagaucaagauguccc

SEQ ID NO: 7914 - RNA, 19 nt, Artificial Sequence
  Description of Artificial Sequence: Synthetic oligonucleotide
gggacaucuugaucuuggc

SEQ ID NO: 7915 - RNA, 19 nt, Artificial Sequence
  Description of Artificial Sequence: Synthetic oligonucleotide
ucuugaucccagccugacu

SEQ ID NO: 7916 - RNA, 19 nt, Artificial Sequence
  Description of Artificial Sequence: Synthetic oligonucleotide
agucaggcugggaucaaga

SEQ ID NO: 7917 - RNA, 19 nt, Artificial Sequence
  Description of Artificial Sequence: Synthetic oligonucleotide
cuugaucccagccugacug

SEQ ID NO: 7918 - RNA, 19 nt, Artificial Sequence
  Description of Artificial Sequence: Synthetic oligonucleotide
cagucaggcugggaucaag

SEQ ID NO: 7919 - RNA, 19 nt, Artificial Sequence
  Description of Artificial Sequence: Synthetic oligonucleotide
uugaucccagccugacugc

SEQ ID NO: 7920 - RNA, 19 nt, Artificial Sequence
  Description of Artificial Sequence: Synthetic oligonucleotide
gcagucaggcugggaucaa

SEQ ID NO: 7921 - RNA, 19 nt, Artificial Sequence
  Description of Artificial Sequence: Synthetic oligonucleotide
ugaucccagccugacugcu

SEQ ID NO: 7922 - RNA, 19 nt, Artificial Sequence
  Description of Artificial Sequence: Synthetic oligonucleotide
agcagucaggcugggauca

SEQ ID NO: 7923 - RNA, 19 nt, Artificial Sequence
  Description of Artificial Sequence: Synthetic oligonucleotide
cugacugcugcuacaucua

SEQ ID NO: 7924 - RNA, 19 nt, Artificial Sequence
  Description of Artificial Sequence: Synthetic oligonucleotide
uagauguagcagcagucag

SEQ ID NO: 7925 - RNA, 19 nt, Artificial Sequence
  Description of Artificial Sequence: Synthetic oligonucleotide
gacugcugcuacaucuaau

SEQ ID NO: 7926 - RNA, 19 nt, Artificial Sequence
  Description of Artificial Sequence: Synthetic oligonucleotide
auuagauguagcagcaguc

SEQ ID NO: 7927 - RNA, 19 nt, Artificial Sequence
  Description of Artificial Sequence: Synthetic oligonucleotide
acugcugcuacaucuaauc

SEQ ID NO: 7928 - RNA, 19 nt, Artificial Sequence
  Description of Artificial Sequence: Synthetic oligonucleotide
gauuagauguagcagcagu

SEQ ID NO: 7929 - RNA, 19 nt, Artificial Sequence
  Description of Artificial Sequence: Synthetic oligonucleotide
cugcugcuacaucuaaucc

SEQ ID NO: 7930 - RNA, 19 nt, Artificial Sequence
  Description of Artificial Sequence: Synthetic oligonucleotide
ggauuagauguagcagcag

SEQ ID NO: 7931 - RNA, 19 nt, Artificial Sequence
  Description of Artificial Sequence: Synthetic oligonucleotide
ugcugcuacaucuaauccc

SEQ ID NO: 7932 - RNA, 19 nt, Artificial Sequence
  Description of Artificial Sequence: Synthetic oligonucleotide
gggauuagauguagcagca

SEQ ID NO: 7933 - RNA, 19 nt, Artificial Sequence
  Description of Artificial Sequence: Synthetic oligonucleotide
ccuaccaaugccuccuguc

SEQ ID NO: 7934 - RNA, 19 nt, Artificial Sequence
  Description of Artificial Sequence: Synthetic oligonucleotide
gacaggaggcauugguagg

SEQ ID NO: 7935 - RNA, 19 nt, Artificial Sequence
  Description of Artificial Sequence: Synthetic oligonucleotide
cuaccaaugccuccugucc

SEQ ID NO: 7936 - RNA, 19 nt, Artificial Sequence
  Description of Artificial Sequence: Synthetic oligonucleotide
ggacaggaggcauugguag

SEQ ID NO: 7937 - RNA, 19 nt, Artificial Sequence
  Description of Artificial Sequence: Synthetic oligonucleotide
ccaaugccuccugucccua

SEQ ID NO: 7938 - RNA, 19 nt, Artificial Sequence
  Description of Artificial Sequence: Synthetic oligonucleotide
uagggacaggaggcauugg

SEQ ID NO: 7939 - RNA, 19 nt, Artificial Sequence
  Description of Artificial Sequence: Synthetic oligonucleotide
caaugccuccugucccuaa

SEQ ID NO: 7940 - RNA, 19 nt, Artificial Sequence
  Description of Artificial Sequence: Synthetic oligonucleotide
uuagggacaggaggcauug

SEQ ID NO: 7941 - RNA, 19 nt, Artificial Sequence
  Description of Artificial Sequence: Synthetic oligonucleotide
aaugccuccugucccuaaa

SEQ ID NO: 7942 - RNA, 19 nt, Artificial Sequence
  Description of Artificial Sequence: Synthetic oligonucleotide
uuuagggacaggaggcauu

SEQ ID NO: 7943 - RNA, 19 nt, Artificial Sequence
  Description of Artificial Sequence: Synthetic oligonucleotide
cccagcauacugaugacag

SEQ ID NO: 7944 - RNA, 19 nt, Artificial Sequence
  Description of Artificial Sequence: Synthetic oligonucleotide
cugucaucaguaugcuggg

SEQ ID NO: 7945 - RNA, 19 nt, Artificial Sequence
  Description of Artificial Sequence: Synthetic oligonucleotide
ccagcauacugaugacagc

SEQ ID NO: 7946 - RNA, 19 nt, Artificial Sequence
  Description of Artificial Sequence: Synthetic oligonucleotide
gcugucaucaguaugcugg

SEQ ID NO: 7947 - RNA, 19 nt, Artificial Sequence
  Description of Artificial Sequence: Synthetic oligonucleotide
cauacugaugacagcccuc

SEQ ID NO: 7948 - RNA, 19 nt, Artificial Sequence
  Description of Artificial Sequence: Synthetic oligonucleotide
gagggcugucaucaguaug

SEQ ID NO: 7949 - RNA, 19 nt, Artificial Sequence
  Description of Artificial Sequence: Synthetic oligonucleotide
auacugaugacagcccucu

SEQ ID NO: 7950 - RNA, 19 nt, Artificial Sequence
  Description of Artificial Sequence: Synthetic oligonucleotide
agagggcugucaucaguau

SEQ ID NO: 7951 - RNA, 19 nt, Artificial Sequence
  Description of Artificial Sequence: Synthetic oligonucleotide
uacugaugacagcccucuc

SEQ ID NO: 7952 - RNA, 19 nt, Artificial Sequence
  Description of Artificial Sequence: Synthetic oligonucleotide
gagagggcugucaucagua

SEQ ID NO: 7953 - RNA, 19 nt, Artificial Sequence
  Description of Artificial Sequence: Synthetic oligonucleotide
acugaugacagcccucucu

SEQ ID NO: 7954 - RNA, 19 nt, Artificial Sequence
  Description of Artificial Sequence: Synthetic oligonucleotide
agagagggcugucaucagu

SEQ ID NO: 7955 - RNA, 19 nt, Artificial Sequence
  Description of Artificial Sequence: Synthetic oligonucleotide
cugaugacagcccucucug

SEQ ID NO: 7956 - RNA, 19 nt, Artificial Sequence
  Description of Artificial Sequence: Synthetic oligonucleotide
cagagagggcugucaucag

SEQ ID NO: 7957 - RNA, 19 nt, Artificial Sequence
  Description of Artificial Sequence: Synthetic oligonucleotide
ugaugacagcccucucuga

SEQ ID NO: 7958 - RNA, 19 nt, Artificial Sequence
  Description of Artificial Sequence: Synthetic oligonucleotide
ucagagagggcugucauca

SEQ ID NO: 7959 - RNA, 19 nt, Artificial Sequence
  Description of Artificial Sequence: Synthetic oligonucleotide
gaugacagcccucucugac

SEQ ID NO: 7960 - RNA, 19 nt, Artificial Sequence
  Description of Artificial Sequence: Synthetic oligonucleotide
gucagagagggcugucauc

SEQ ID NO: 7961 - RNA, 19 nt, Artificial Sequence
  Description of Artificial Sequence: Synthetic oligonucleotide
augacagcccucucugacu

SEQ ID NO: 7962 - RNA, 19 nt, Artificial Sequence
  Description of Artificial Sequence: Synthetic oligonucleotide
agucagagagggcugucau

SEQ ID NO: 7963 - RNA, 19 nt, Artificial Sequence
  Description of Artificial Sequence: Synthetic oligonucleotide
ugacagcccucucugacuu

SEQ ID NO: 7964 - RNA, 19 nt, Artificial Sequence
  Description of Artificial Sequence: Synthetic oligonucleotide
aagucagagagggcuguca

SEQ ID NO: 7965 - RNA, 19 nt, Artificial Sequence
  Description of Artificial Sequence: Synthetic oligonucleotide
gacagcccucucugacuuu

SEQ ID NO: 7966 - RNA, 19 nt, Artificial Sequence
  Description of Artificial Sequence: Synthetic oligonucleotide
aaagucagagagggcuguc

SEQ ID NO: 7967 - RNA, 19 nt, Artificial Sequence
  Description of Artificial Sequence: Synthetic oligonucleotide
acagcccucucugacuuua

SEQ ID NO: 7968 - RNA, 19 nt, Artificial Sequence
  Description of Artificial Sequence: Synthetic oligonucleotide
uaaagucagagagggcugu

SEQ ID NO: 7969 - RNA, 19 nt, Artificial Sequence
  Description of Artificial Sequence: Synthetic oligonucleotide
cagcccucucugacuuuac

SEQ ID NO: 7970 - RNA, 19 nt, Artificial Sequence
  Description of Artificial Sequence: Synthetic oligonucleotide
guaaagucagagagggcug

SEQ ID NO: 7971 - RNA, 19 nt, Artificial Sequence
  Description of Artificial Sequence: Synthetic oligonucleotide
agcccucucugacuuuacc

SEQ ID NO: 7972 - RNA, 19 nt, Artificial Sequence
  Description of Artificial Sequence: Synthetic oligonucleotide
gguaaagucagagagggcu

SEQ ID NO: 7973 - RNA, 19 nt, Artificial Sequence
  Description of Artificial Sequence: Synthetic oligonucleotide
gcccucucugacuuuaccu

SEQ ID NO: 7974 - RNA, 19 nt, Artificial Sequence
  Description of Artificial Sequence: Synthetic oligonucleotide
agguaaagucagagagggc

SEQ ID NO: 7975 - RNA, 19 nt, Artificial Sequence
  Description of Artificial Sequence: Synthetic oligonucleotide
cccucucugacuuuaccuu

SEQ ID NO: 7976 - RNA, 19 nt, Artificial Sequence
  Description of Artificial Sequence: Synthetic oligonucleotide
aagguaaagucagagaggg

SEQ ID NO: 7977 - RNA, 19 nt, Artificial Sequence
  Description of Artificial Sequence: Synthetic oligonucleotide
ccucucugacuuuaccuug

SEQ ID NO: 7978 - RNA, 19 nt, Artificial Sequence
  Description of Artificial Sequence: Synthetic oligonucleotide
caagguaaagucagagagg

SEQ ID NO: 7979 - RNA, 19 nt, Artificial Sequence
  Description of Artificial Sequence: Synthetic oligonucleotide
cucucugacuuuaccuuga

SEQ ID NO: 7980 - RNA, 19 nt, Artificial Sequence
  Description of Artificial Sequence: Synthetic oligonucleotide
ucaagguaaagucagagag

SEQ ID NO: 7981 - RNA, 19 nt, Artificial Sequence
  Description of Artificial Sequence: Synthetic oligonucleotide
agaucugucuucauacccu

SEQ ID NO: 7982 - RNA, 19 nt, Artificial Sequence
  Description of Artificial Sequence: Synthetic oligonucleotide
aggguaugaagacagaucu

SEQ ID NO: 7983 - RNA, 19 nt, Artificial Sequence
  Description of Artificial Sequence: Synthetic oligonucleotide
gaucugucuucauacccuu

SEQ ID NO: 7984 - RNA, 19 nt, Artificial Sequence
  Description of Artificial Sequence: Synthetic oligonucleotide
aaggguaugaagacagauc

SEQ ID NO: 7985 - RNA, 19 nt, Artificial Sequence
  Description of Artificial Sequence: Synthetic oligonucleotide
cugucuucauacccuuccc

SEQ ID NO: 7986 - RNA, 19 nt, Artificial Sequence
  Description of Artificial Sequence: Synthetic oligonucleotide
gggaaggguaugaagacag

SEQ ID NO: 7987 - RNA, 19 nt, Artificial Sequence
  Description of Artificial Sequence: Synthetic oligonucleotide
acaccagaagucacauuuc

SEQ ID NO: 7988 - RNA, 19 nt, Artificial Sequence
  Description of Artificial Sequence: Synthetic oligonucleotide
gaaaugugacuucuggugu

SEQ ID NO: 7989 - RNA, 19 nt, Artificial Sequence
  Description of Artificial Sequence: Synthetic oligonucleotide
gaagucacauuucauccuu

SEQ ID NO: 7990 - RNA, 19 nt, Artificial Sequence
  Description of Artificial Sequence: Synthetic oligonucleotide
aaggaugaaaugugacuuc

SEQ ID NO: 7991 - RNA, 19 nt, Artificial Sequence
  Description of Artificial Sequence: Synthetic oligonucleotide
aagucacauuucauccuuu

SEQ ID NO: 7992 - RNA, 19 nt, Artificial Sequence
  Description of Artificial Sequence: Synthetic oligonucleotide
aaaggaugaaaugugacuu

SEQ ID NO: 7993 - RNA, 19 nt, Artificial Sequence
  Description of Artificial Sequence: Synthetic oligonucleotide
agucacauuucauccuuuu

SEQ ID NO: 7994 - RNA, 19 nt, Artificial Sequence
  Description of Artificial Sequence: Synthetic oligonucleotide
aaaaggaugaaaugugacu

SEQ ID NO: 7995 - RNA, 19 nt, Artificial Sequence
  Description of Artificial Sequence: Synthetic oligonucleotide
uuucauccuuuuacauggu

SEQ ID NO: 7996 - RNA, 19 nt, Artificial Sequence
  Description of Artificial Sequence: Synthetic oligonucleotide
accauguaaaaggaugaaa

SEQ ID NO: 7997 - RNA, 19 nt, Artificial Sequence
  Description of Artificial Sequence: Synthetic oligonucleotide
uucauccuuuuacaugguu

SEQ ID NO: 7998 - RNA, 19 nt, Artificial Sequence
  Description of Artificial Sequence: Synthetic oligonucleotide
aaccauguaaaaggaugaa

SEQ ID NO: 7999 - RNA, 19 nt, Artificial Sequence
  Description of Artificial Sequence: Synthetic oligonucleotide
ucauccuuuuacaugguuc

SEQ ID NO: 8000 - RNA, 19 nt, Artificial Sequence
  Description of Artificial Sequence: Synthetic oligonucleotide
gaaccauguaaaaggauga

SEQ ID NO: 8001 - RNA, 19 nt, Artificial Sequence
  Description of Artificial Sequence: Synthetic oligonucleotide
cauccuuuuacaugguucc

SEQ ID NO: 8002 - RNA, 19 nt, Artificial Sequence
  Description of Artificial Sequence: Synthetic oligonucleotide
ggaaccauguaaaaggaug

SEQ ID NO: 8003 - RNA, 19 nt, Artificial Sequence
  Description of Artificial Sequence: Synthetic oligonucleotide
ugguucccaucuacccuca

SEQ ID NO: 8004 - RNA, 19 nt, Artificial Sequence
  Description of Artificial Sequence: Synthetic oligonucleotide
ugaggguagaugggaacca

SEQ ID NO: 8005 - RNA, 19 nt, Artificial Sequence
  Description of Artificial Sequence: Synthetic oligonucleotide
gguucccaucuacccucac

SEQ ID NO: 8006 - RNA, 19 nt, Artificial Sequence
  Description of Artificial Sequence: Synthetic oligonucleotide
gugaggguagaugggaacc

SEQ ID NO: 8007 - RNA, 19 nt, Artificial Sequence
  Description of Artificial Sequence: Synthetic oligonucleotide
guucccaucuacccucaca

SEQ ID NO: 8008 - RNA, 19 nt, Artificial Sequence
  Description of Artificial Sequence: Synthetic oligonucleotide
ugugaggguagaugggaac

SEQ ID NO: 8009 - RNA, 19 nt, Artificial Sequence
  Description of Artificial Sequence: Synthetic oligonucleotide
ggcaauucuuccuccagga

SEQ ID NO: 8010 - RNA, 19 nt, Artificial Sequence
  Description of Artificial Sequence: Synthetic oligonucleotide
uccuggaggaagaauugcc

SEQ ID NO: 8011 - RNA, 19 nt, Artificial Sequence
  Description of Artificial Sequence: Synthetic oligonucleotide
gcaauucuuccuccaggac

SEQ ID NO: 8012 - RNA, 19 nt, Artificial Sequence
  Description of Artificial Sequence: Synthetic oligonucleotide
guccuggaggaagaauugc

SEQ ID NO: 8013 - RNA, 19 nt, Artificial Sequence
  Description of Artificial Sequence: Synthetic oligonucleotide
caauucuuccuccaggacc

SEQ ID NO: 8014 - RNA, 19 nt, Artificial Sequence
  Description of Artificial Sequence: Synthetic oligonucleotide
gguccuggaggaagaauug

SEQ ID NO: 8015 - RNA, 19 nt, Artificial Sequence
  Description of Artificial Sequence: Synthetic oligonucleotide
aauucuuccuccaggaccc

SEQ ID NO: 8016 - RNA, 19 nt, Artificial Sequence
  Description of Artificial Sequence: Synthetic oligonucleotide
ggguccuggaggaagaauu

SEQ ID NO: 8017 - RNA, 19 nt, Artificial Sequence
  Description of Artificial Sequence: Synthetic oligonucleotide
cccuuggacuuugcccuuc

SEQ ID NO: 8018 - RNA, 19 nt, Artificial Sequence
  Description of Artificial Sequence: Synthetic oligonucleotide
gaagggcaaaguccaaggg

SEQ ID NO: 8019 - RNA, 19 nt, Artificial Sequence
  Description of Artificial Sequence: Synthetic oligonucleotide
ccuuggacuuugcccuucu

SEQ ID NO: 8020 - RNA, 19 nt, Artificial Sequence
  Description of Artificial Sequence: Synthetic oligonucleotide
agaagggcaaaguccaagg

SEQ ID NO: 8021 - RNA, 19 nt, Artificial Sequence
  Description of Artificial Sequence: Synthetic oligonucleotide
cuuggacuuugcccuucuu

SEQ ID NO: 8022 - RNA, 19 nt, Artificial Sequence
  Description of Artificial Sequence: Synthetic oligonucleotide
aagaagggcaaaguccaag

SEQ ID NO: 8023 - RNA, 19 nt, Artificial Sequence
  Description of Artificial Sequence: Synthetic oligonucleotide
uuggacuuugcccuucuua

SEQ ID NO: 8024 - RNA, 19 nt, Artificial Sequence
  Description of Artificial Sequence: Synthetic oligonucleotide
uaagaagggcaaaguccaa

SEQ ID NO: 8025 - RNA, 19 nt, Artificial Sequence
  Description of Artificial Sequence: Synthetic oligonucleotide
uggacuuugcccuucuuac

SEQ ID NO: 8026 - RNA, 19 nt, Artificial Sequence
  Description of Artificial Sequence: Synthetic oligonucleotide
guaagaagggcaaagucca

SEQ ID NO: 8027 - RNA, 19 nt, Artificial Sequence
  Description of Artificial Sequence: Synthetic oligonucleotide
ggacuuugcccuucuuacu

SEQ ID NO: 8028 - RNA, 19 nt, Artificial Sequence
  Description of Artificial Sequence: Synthetic oligonucleotide
aguaagaagggcaaagucc

SEQ ID NO: 8029 - RNA, 19 nt, Artificial Sequence
  Description of Artificial Sequence: Synthetic oligonucleotide
uuugcccuucuuacuggcc

SEQ ID NO: 8030 - RNA, 19 nt, Artificial Sequence
  Description of Artificial Sequence: Synthetic oligonucleotide
ggccaguaagaagggcaaa

SEQ ID NO: 8031 - RNA, 19 nt, Artificial Sequence
  Description of Artificial Sequence: Synthetic oligonucleotide
uugcccuucuuacuggcca

SEQ ID NO: 8032 - RNA, 19 nt, Artificial Sequence
  Description of Artificial Sequence: Synthetic oligonucleotide
uggccaguaagaagggcaa

SEQ ID NO: 8033 - RNA, 19 nt, Artificial Sequence
  Description of Artificial Sequence: Synthetic oligonucleotide
ugcccuucuuacuggccag

SEQ ID NO: 8034 - RNA, 19 nt, Artificial Sequence
  Description of Artificial Sequence: Synthetic oligonucleotide
cuggccaguaagaagggca

SEQ ID NO: 8035 - RNA, 19 nt, Artificial Sequence
  Description of Artificial Sequence: Synthetic oligonucleotide
ucuuacuggccaggcaggg

SEQ ID NO: 8036 - RNA, 19 nt, Artificial Sequence
  Description of Artificial Sequence: Synthetic oligonucleotide
cccugccuggccaguaaga

SEQ ID NO: 8037 - RNA, 19 nt, Artificial Sequence
  Description of Artificial Sequence: Synthetic oligonucleotide
ggccagaguccaggcuuga

SEQ ID NO: 8038 - RNA, 19 nt, Artificial Sequence
  Description of Artificial Sequence: Synthetic oligonucleotide
ucaagccuggacucuggcc

SEQ ID NO: 8039 - RNA, 19 nt, Artificial Sequence
  Description of Artificial Sequence: Synthetic oligonucleotide
gccagaguccaggcuugac

SEQ ID NO: 8040 - RNA, 19 nt, Artificial Sequence
  Description of Artificial Sequence: Synthetic oligonucleotide
gucaagccuggacucuggc

SEQ ID NO: 8041 - RNA, 19 nt, Artificial Sequence
  Description of Artificial Sequence: Synthetic oligonucleotide
guccaggcuugacucauuc

SEQ ID NO: 8042 - RNA, 19 nt, Artificial Sequence
  Description of Artificial Sequence: Synthetic oligonucleotide
gaaugagucaagccuggac

SEQ ID NO: 8043 - RNA, 19 nt, Artificial Sequence
  Description of Artificial Sequence: Synthetic oligonucleotide
aggcuugacucauucccac

SEQ ID NO: 8044 - RNA, 19 nt, Artificial Sequence
  Description of Artificial Sequence: Synthetic oligonucleotide
gugggaaugagucaagccu

SEQ ID NO: 8045 - RNA, 19 nt, Artificial Sequence
  Description of Artificial Sequence: Synthetic oligonucleotide
gacucauucccaccuuguc

SEQ ID NO: 8046 - RNA, 19 nt, Artificial Sequence
  Description of Artificial Sequence: Synthetic oligonucleotide
gacaaggugggaaugaguc

SEQ ID NO: 8047 - RNA, 19 nt, Artificial Sequence
  Description of Artificial Sequence: Synthetic oligonucleotide
acucauucccaccuugucc

SEQ ID NO: 8048 - RNA, 19 nt, Artificial Sequence
  Description of Artificial Sequence: Synthetic oligonucleotide
ggacaaggugggaaugagu

SEQ ID NO: 8049 - RNA, 19 nt, Artificial Sequence
  Description of Artificial Sequence: Synthetic oligonucleotide
ucauucccaccuuguccug

SEQ ID NO: 8050 - RNA, 19 nt, Artificial Sequence
  Description of Artificial Sequence: Synthetic oligonucleotide
caggacaaggugggaauga

SEQ ID NO: 8051 - RNA, 19 nt, Artificial Sequence
  Description of Artificial Sequence: Synthetic oligonucleotide
caccuuguccugggcugag

SEQ ID NO: 8052 - RNA, 19 nt, Artificial Sequence
  Description of Artificial Sequence: Synthetic oligonucleotide
cucagcccaggacaaggug

SEQ ID NO: 8053 - RNA, 19 nt, Artificial Sequence
  Description of Artificial Sequence: Synthetic oligonucleotide
accacccagcccagaaguu

SEQ ID NO: 8054 - RNA, 19 nt, Artificial Sequence
  Description of Artificial Sequence: Synthetic oligonucleotide
aacuucugggcuggguggu

SEQ ID NO: 8055 - RNA, 19 nt, Artificial Sequence
  Description of Artificial Sequence: Synthetic oligonucleotide
ccacccagcccagaaguuc

SEQ ID NO: 8056 - RNA, 19 nt, Artificial Sequence
  Description of Artificial Sequence: Synthetic oligonucleotide
gaacuucugggcugggugg

SEQ ID NO: 8057 - RNA, 19 nt, Artificial Sequence
  Description of Artificial Sequence: Synthetic oligonucleotide
cacccagcccagaaguucc

SEQ ID NO: 8058 - RNA, 19 nt, Artificial Sequence
  Description of Artificial Sequence: Synthetic oligonucleotide
ggaacuucugggcugggug

SEQ ID NO: 8059 - RNA, 19 nt, Artificial Sequence
  Description of Artificial Sequence: Synthetic oligonucleotide
acccagcccagaaguucca

SEQ ID NO: 8060 - RNA, 19 nt, Artificial Sequence
  Description of Artificial Sequence: Synthetic oligonucleotide
uggaacuucugggcugggu

SEQ ID NO: 8061 - RNA, 19 nt, Artificial Sequence
  Description of Artificial Sequence: Synthetic oligonucleotide
ccagaaguuccagggaagg

SEQ ID NO: 8062 - RNA, 19 nt, Artificial Sequence
  Description of Artificial Sequence: Synthetic oligonucleotide
ccuucccuggaacuucugg

SEQ ID NO: 8063 - RNA, 19 nt, Artificial Sequence
  Description of Artificial Sequence: Synthetic oligonucleotide
cagaaguuccagggaagga

SEQ ID NO: 8064 - RNA, 19 nt, Artificial Sequence
  Description of Artificial Sequence: Synthetic oligonucleotide
uccuucccuggaacuucug

SEQ ID NO: 8065 - RNA, 19 nt, Artificial Sequence
  Description of Artificial Sequence: Synthetic oligonucleotide
aacucuccgguccaccaug

SEQ ID NO: 8066 - RNA, 19 nt, Artificial Sequence
  Description of Artificial Sequence: Synthetic oligonucleotide
caugguggaccggagaguu

SEQ ID NO: 8067 - RNA, 19 nt, Artificial Sequence
  Description of Artificial Sequence: Synthetic oligonucleotide
acucuccgguccaccaugg

SEQ ID NO: 8068 - RNA, 19 nt, Artificial Sequence
  Description of Artificial Sequence: Synthetic oligonucleotide
ccaugguggaccggagagu

SEQ ID NO: 8069 - RNA, 19 nt, Artificial Sequence
  Description of Artificial Sequence: Synthetic oligonucleotide
caccauggaguaccucuca

SEQ ID NO: 8070 - RNA, 19 nt, Artificial Sequence
  Description of Artificial Sequence: Synthetic oligonucleotide
ugagagguacuccauggug

SEQ ID NO: 8071 - RNA, 19 nt, Artificial Sequence
  Description of Artificial Sequence: Synthetic oligonucleotide
accauggaguaccucucag

SEQ ID NO: 8072 - RNA, 19 nt, Artificial Sequence
  Description of Artificial Sequence: Synthetic oligonucleotide
cugagagguacuccauggu

SEQ ID NO: 8073 - RNA, 19 nt, Artificial Sequence
  Description of Artificial Sequence: Synthetic oligonucleotide
uggaguaccucucagcucu

SEQ ID NO: 8074 - RNA, 19 nt, Artificial Sequence
  Description of Artificial Sequence: Synthetic oligonucleotide
agagcugagagguacucca

SEQ ID NO: 8075 - RNA, 19 nt, Artificial Sequence
  Description of Artificial Sequence: Synthetic oligonucleotide
ggaguaccucucagcucug

SEQ ID NO: 8076 - RNA, 19 nt, Artificial Sequence
  Description of Artificial Sequence: Synthetic oligonucleotide
cagagcugagagguacucc

SEQ ID NO: 8077 - RNA, 19 nt, Artificial Sequence
  Description of Artificial Sequence: Synthetic oligonucleotide
gaguaccucucagcucuga

SEQ ID NO: 8078 - RNA, 19 nt, Artificial Sequence
  Description of Artificial Sequence: Synthetic oligonucleotide
ucagagcugagagguacuc

SEQ ID NO: 8079 - RNA, 19 nt, Artificial Sequence
  Description of Artificial Sequence: Synthetic oligonucleotide
aguaccucucagcucugaa

SEQ ID NO: 8080 - RNA, 19 nt, Artificial Sequence
  Description of Artificial Sequence: Synthetic oligonucleotide
uucagagcugagagguacu

SEQ ID NO: 8081 - RNA, 19 nt, Artificial Sequence
  Description of Artificial Sequence: Synthetic oligonucleotide
ccagugacuuacucaggug

SEQ ID NO: 8082 - RNA, 19 nt, Artificial Sequence
  Description of Artificial Sequence: Synthetic oligonucleotide
caccugaguaagucacugg

SEQ ID NO: 8083 - RNA, 19 nt, Artificial Sequence
  Description of Artificial Sequence: Synthetic oligonucleotide
cagugacuuacucagguga

SEQ ID NO: 8084 - RNA, 19 nt, Artificial Sequence
  Description of Artificial Sequence: Synthetic oligonucleotide
ucaccugaguaagucacug

SEQ ID NO: 8085 - RNA, 19 nt, Artificial Sequence
  Description of Artificial Sequence: Synthetic oligonucleotide
agugacuuacucaggugac

SEQ ID NO: 8086 - RNA, 19 nt, Artificial Sequence
  Description of Artificial Sequence: Synthetic oligonucleotide
gucaccugaguaagucacu

SEQ ID NO: 8087 - RNA, 19 nt, Artificial Sequence
  Description of Artificial Sequence: Synthetic oligonucleotide
gugacuuacucaggugacu

SEQ ID NO: 8088 - RNA, 19 nt, Artificial Sequence
  Description of Artificial Sequence: Synthetic oligonucleotide
agucaccugaguaagucac

SEQ ID NO: 8089 - RNA, 19 nt, Artificial Sequence
  Description of Artificial Sequence: Synthetic oligonucleotide
ugacuuacucaggugacug

SEQ ID NO: 8090 - RNA, 19 nt, Artificial Sequence
  Description of Artificial Sequence: Synthetic oligonucleotide
cagucaccugaguaaguca

SEQ ID NO: 8091 - RNA, 19 nt, Artificial Sequence
  Description of Artificial Sequence: Synthetic oligonucleotide
gacuuacucaggugacugc

SEQ ID NO: 8092 - RNA, 19 nt, Artificial Sequence
  Description of Artificial Sequence: Synthetic oligonucleotide
gcagucaccugaguaaguc

SEQ ID NO: 8093 - RNA, 19 nt, Artificial Sequence
  Description of Artificial Sequence: Synthetic oligonucleotide
acuuacucaggugacugcu

SEQ ID NO: 8094 - RNA, 19 nt, Artificial Sequence
  Description of Artificial Sequence: Synthetic oligonucleotide
agcagucaccugaguaagu

SEQ ID NO: 8095 - RNA, 19 nt, Artificial Sequence
  Description of Artificial Sequence: Synthetic oligonucleotide
cuuacucaggugacugcua

SEQ ID NO: 8096 - RNA, 19 nt, Artificial Sequence
  Description of Artificial Sequence: Synthetic oligonucleotide
uagcagucaccugaguaag

SEQ ID NO: 8097 - RNA, 19 nt, Artificial Sequence
  Description of Artificial Sequence: Synthetic oligonucleotide
uuacucaggugacugcuaa

SEQ ID NO: 8098 - RNA, 19 nt, Artificial Sequence
  Description of Artificial Sequence: Synthetic oligonucleotide
uuagcagucaccugaguaa

SEQ ID NO: 8099 - RNA, 19 nt, Artificial Sequence
  Description of Artificial Sequence: Synthetic oligonucleotide
uacucaggugacugcuaac

SEQ ID NO: 8100 - RNA, 19 nt, Artificial Sequence
  Description of Artificial Sequence: Synthetic oligonucleotide
guuagcagucaccugagua

SEQ ID NO: 8101 - RNA, 19 nt, Artificial Sequence
  Description of Artificial Sequence: Synthetic oligonucleotide
acucaggugacugcuaacc

SEQ ID NO: 8102 - RNA, 19 nt, Artificial Sequence
  Description of Artificial Sequence: Synthetic oligonucleotide
gguuagcagucaccugagu

SEQ ID NO: 8103 - RNA, 19 nt, Artificial Sequence
  Description of Artificial Sequence: Synthetic oligonucleotide
cucaggugacugcuaaccc

SEQ ID NO: 8104 - RNA, 19 nt, Artificial Sequence
  Description of Artificial Sequence: Synthetic oligonucleotide
ggguuagcagucaccugag

SEQ ID NO: 8105 - RNA, 19 nt, Artificial Sequence
  Description of Artificial Sequence: Synthetic oligonucleotide
ggugacugcuaacccuccg

SEQ ID NO: 8106 - RNA, 19 nt, Artificial Sequence
  Description of Artificial Sequence: Synthetic oligonucleotide
cggaggguuagcagucacc

SEQ ID NO: 8107 - RNA, 19 nt, Artificial Sequence
  Description of Artificial Sequence: Synthetic oligonucleotide
gugacugcuaacccuccgc

SEQ ID NO: 8108 - RNA, 19 nt, Artificial Sequence
  Description of Artificial Sequence: Synthetic oligonucleotide
gcggaggguuagcagucac

SEQ ID NO: 8109 - RNA, 19 nt, Artificial Sequence
  Description of Artificial Sequence: Synthetic oligonucleotide
ugacugcuaacccuccgcu

SEQ ID NO: 8110 - RNA, 19 nt, Artificial Sequence
  Description of Artificial Sequence: Synthetic oligonucleotide
agcggaggguuagcaguca

SEQ ID NO: 8111 - RNA, 19 nt, Artificial Sequence
  Description of Artificial Sequence: Synthetic oligonucleotide
gacugcuaacccuccgcuc

SEQ ID NO: 8112 - RNA, 19 nt, Artificial Sequence
  Description of Artificial Sequence: Synthetic oligonucleotide
gagcggaggguuagcaguc

SEQ ID NO: 8113 - RNA, 19 nt, Artificial Sequence
  Description of Artificial Sequence: Synthetic oligonucleotide
acugcuaacccuccgcucu

SEQ ID NO: 8114 - RNA, 19 nt, Artificial Sequence
  Description of Artificial Sequence: Synthetic oligonucleotide
agagcggaggguuagcagu

SEQ ID NO: 8115 - RNA, 19 nt, Artificial Sequence
  Description of Artificial Sequence: Synthetic oligonucleotide
cugcuaacccuccgcucua

SEQ ID NO: 8116 - RNA, 19 nt, Artificial Sequence
  Description of Artificial Sequence: Synthetic oligonucleotide
uagagcggaggguuagcag

SEQ ID NO: 8117 - RNA, 19 nt, Artificial Sequence
  Description of Artificial Sequence: Synthetic oligonucleotide
ugcuaacccuccgcucuac

SEQ ID NO: 8118 - RNA, 19 nt, Artificial Sequence
  Description of Artificial Sequence: Synthetic oligonucleotide
guagagcggaggguuagca

SEQ ID NO: 8119 - RNA, 19 nt, Artificial Sequence
  Description of Artificial Sequence: Synthetic oligonucleotide
aacccuccgcucuacccuc

SEQ ID NO: 8120 - RNA, 19 nt, Artificial Sequence
  Description of Artificial Sequence: Synthetic oligonucleotide
gaggguagagcggaggguu

SEQ ID NO: 8121 - RNA, 19 nt, Artificial Sequence
  Description of Artificial Sequence: Synthetic oligonucleotide
acuccacagugggcuuguc

SEQ ID NO: 8122 - RNA, 19 nt, Artificial Sequence
  Description of Artificial Sequence: Synthetic oligonucleotide
gacaagcccacuguggagu

SEQ ID NO: 8123 - RNA, 19 nt, Artificial Sequence
  Description of Artificial Sequence: Synthetic oligonucleotide
cuccacagugggcuuguca

SEQ ID NO: 8124 - RNA, 19 nt, Artificial Sequence
  Description of Artificial Sequence: Synthetic oligonucleotide
ugacaagcccacuguggag

SEQ ID NO: 8125 - RNA, 19 nt, Artificial Sequence
  Description of Artificial Sequence: Synthetic oligonucleotide
uccacagugggcuugucaa

SEQ ID NO: 8126 - RNA, 19 nt, Artificial Sequence
  Description of Artificial Sequence: Synthetic oligonucleotide
uugacaagcccacugugga

SEQ ID NO: 8127 - RNA, 19 nt, Artificial Sequence
  Description of Artificial Sequence: Synthetic oligonucleotide
ccacagugggcuugucaag

SEQ ID NO: 8128 - RNA, 19 nt, Artificial Sequence
  Description of Artificial Sequence: Synthetic oligonucleotide
cuugacaagcccacugugg

SEQ ID NO: 8129 - RNA, 19 nt, Artificial Sequence
  Description of Artificial Sequence: Synthetic oligonucleotide
gucaagcuccugagccacc

SEQ ID NO: 8130 - RNA, 19 nt, Artificial Sequence
  Description of Artificial Sequence: Synthetic oligonucleotide
gguggcucaggagcuugac

SEQ ID NO: 8131 - RNA, 19 nt, Artificial Sequence
  Description of Artificial Sequence: Synthetic oligonucleotide
ccauggucucucccucauc

SEQ ID NO: 8132 - RNA, 19 nt, Artificial Sequence
  Description of Artificial Sequence: Synthetic oligonucleotide
gaugagggagagaccaugg

SEQ ID NO: 8133 - RNA, 19 nt, Artificial Sequence
  Description of Artificial Sequence: Synthetic oligonucleotide
cauggucucucccucaucc

SEQ ID NO: 8134 - RNA, 19 nt, Artificial Sequence
  Description of Artificial Sequence: Synthetic oligonucleotide
ggaugagggagagaccaug

SEQ ID NO: 8135 - RNA, 19 nt, Artificial Sequence
  Description of Artificial Sequence: Synthetic oligonucleotide
auggucucucccucauccc

SEQ ID NO: 8136 - RNA, 19 nt, Artificial Sequence
  Description of Artificial Sequence: Synthetic oligonucleotide
gggaugagggagagaccau

SEQ ID NO: 8137 - RNA, 19 nt, Artificial Sequence
  Description of Artificial Sequence: Synthetic oligonucleotide
ucucucccucaucccuaau

SEQ ID NO: 8138 - RNA, 19 nt, Artificial Sequence
  Description of Artificial Sequence: Synthetic oligonucleotide
auuagggaugagggagaga

SEQ ID NO: 8139 - RNA, 19 nt, Artificial Sequence
  Description of Artificial Sequence: Synthetic oligonucleotide
cucucccucaucccuaauc

SEQ ID NO: 8140 - RNA, 19 nt, Artificial Sequence
  Description of Artificial Sequence: Synthetic oligonucleotide
gauuagggaugagggagag

SEQ ID NO: 8141 - RNA, 19 nt, Artificial Sequence
  Description of Artificial Sequence: Synthetic oligonucleotide
ucucccucaucccuaaucg

SEQ ID NO: 8142 - RNA, 19 nt, Artificial Sequence
  Description of Artificial Sequence: Synthetic oligonucleotide
cgauuagggaugagggaga

SEQ ID NO: 8143 - RNA, 19 nt, Artificial Sequence
  Description of Artificial Sequence: Synthetic oligonucleotide
cucccucaucccuaaucga

SEQ ID NO: 8144 - RNA, 19 nt, Artificial Sequence
  Description of Artificial Sequence: Synthetic oligonucleotide
ucgauuagggaugagggag

SEQ ID NO: 8145 - RNA, 19 nt, Artificial Sequence
  Description of Artificial Sequence: Synthetic oligonucleotide
ucccucaucccuaaucgau

SEQ ID NO: 8146 - RNA, 19 nt, Artificial Sequence
  Description of Artificial Sequence: Synthetic oligonucleotide
aucgauuagggaugaggga

SEQ ID NO: 8147 - RNA, 19 nt, Artificial Sequence
  Description of Artificial Sequence: Synthetic oligonucleotide
cccucaucccuaaucgaua

SEQ ID NO: 8148 - RNA, 19 nt, Artificial Sequence
  Description of Artificial Sequence: Synthetic oligonucleotide
uaucgauuagggaugaggg

SEQ ID NO: 8149 - RNA, 19 nt, Artificial Sequence
  Description of Artificial Sequence: Synthetic oligonucleotide
ccucaucccuaaucgauaa

SEQ ID NO: 8150 - RNA, 19 nt, Artificial Sequence
  Description of Artificial Sequence: Synthetic oligonucleotide
uuaucgauuagggaugagg

SEQ ID NO: 8151 - RNA, 19 nt, Artificial Sequence
  Description of Artificial Sequence: Synthetic oligonucleotide
cucaucccuaaucgauaaa

SEQ ID NO: 8152 - RNA, 19 nt, Artificial Sequence
  Description of Artificial Sequence: Synthetic oligonucleotide
uuuaucgauuagggaugag

SEQ ID NO: 8153 - RNA, 19 nt, Artificial Sequence
  Description of Artificial Sequence: Synthetic oligonucleotide
aaccuagaucucucccucc

SEQ ID NO: 8154 - RNA, 19 nt, Artificial Sequence
  Description of Artificial Sequence: Synthetic oligonucleotide
ggagggagagaucuagguu

SEQ ID NO: 8155 - RNA, 19 nt, Artificial Sequence
  Description of Artificial Sequence: Synthetic oligonucleotide
accuagaucucucccuccc

SEQ ID NO: 8156 - RNA, 19 nt, Artificial Sequence
  Description of Artificial Sequence: Synthetic oligonucleotide
gggagggagagaucuaggu

SEQ ID NO: 8157 - RNA, 19 nt, Artificial Sequence
  Description of Artificial Sequence: Synthetic oligonucleotide
cuagaucucucccucccua

SEQ ID NO: 8158 - RNA, 19 nt, Artificial Sequence
  Description of Artificial Sequence: Synthetic oligonucleotide
uagggagggagagaucuag

SEQ ID NO: 8159 - RNA, 19 nt, Artificial Sequence
  Description of Artificial Sequence: Synthetic oligonucleotide
uagaucucucccucccuag

SEQ ID NO: 8160 - RNA, 19 nt, Artificial Sequence
  Description of Artificial Sequence: Synthetic oligonucleotide
cuagggagggagagaucua

SEQ ID NO: 8161 - RNA, 19 nt, Artificial Sequence
  Description of Artificial Sequence: Synthetic oligonucleotide
agaucucucccucccuagc

SEQ ID NO: 8162 - RNA, 19 nt, Artificial Sequence
  Description of Artificial Sequence: Synthetic oligonucleotide
gcuagggagggagagaucu

SEQ ID NO: 8163 - RNA, 19 nt, Artificial Sequence
  Description of Artificial Sequence: Synthetic oligonucleotide
gaucucucccucccuagcc

SEQ ID NO: 8164 - RNA, 19 nt, Artificial Sequence
  Description of Artificial Sequence: Synthetic oligonucleotide
ggcuagggagggagagauc

SEQ ID NO: 8165 - RNA, 19 nt, Artificial Sequence
  Description of Artificial Sequence: Synthetic oligonucleotide
aucucucccucccuagccc

SEQ ID NO: 8166 - RNA, 19 nt, Artificial Sequence
  Description of Artificial Sequence: Synthetic oligonucleotide
gggcuagggagggagagau

SEQ ID NO: 8167 - RNA, 19 nt, Artificial Sequence
  Description of Artificial Sequence: Synthetic oligonucleotide
uagcccucuagccacucua

SEQ ID NO: 8168 - RNA, 19 nt, Artificial Sequence
  Description of Artificial Sequence: Synthetic oligonucleotide
uagaguggcuagagggcua

SEQ ID NO: 8169 - RNA, 19 nt, Artificial Sequence
  Description of Artificial Sequence: Synthetic oligonucleotide
agcccucuagccacucuac

SEQ ID NO: 8170 - RNA, 19 nt, Artificial Sequence
  Description of Artificial Sequence: Synthetic oligonucleotide
guagaguggcuagagggcu

SEQ ID NO: 8171 - RNA, 19 nt, Artificial Sequence
  Description of Artificial Sequence: Synthetic oligonucleotide
cucuagccacucuacccuc

SEQ ID NO: 8172 - RNA, 19 nt, Artificial Sequence
  Description of Artificial Sequence: Synthetic oligonucleotide
gaggguagaguggcuagag

SEQ ID NO: 8173 - RNA, 19 nt, Artificial Sequence
  Description of Artificial Sequence: Synthetic oligonucleotide
ucuagccacucuacccuca

SEQ ID NO: 8174 - RNA, 19 nt, Artificial Sequence
  Description of Artificial Sequence: Synthetic oligonucleotide
ugaggguagaguggcuaga

SEQ ID NO: 8175 - RNA, 19 nt, Artificial Sequence
  Description of Artificial Sequence: Synthetic oligonucleotide
cuagccacucuacccucau

SEQ ID NO: 8176 - RNA, 19 nt, Artificial Sequence
  Description of Artificial Sequence: Synthetic oligonucleotide
augaggguagaguggcuag

SEQ ID NO: 8177 - RNA, 19 nt, Artificial Sequence
  Description of Artificial Sequence: Synthetic oligonucleotide
uagccacucuacccucauc

SEQ ID NO: 8178 - RNA, 19 nt, Artificial Sequence
  Description of Artificial Sequence: Synthetic oligonucleotide
gaugaggguagaguggcua

SEQ ID NO: 8179 - RNA, 19 nt, Artificial Sequence
  Description of Artificial Sequence: Synthetic oligonucleotide
agccacucuacccucauca

SEQ ID NO: 8180 - RNA, 19 nt, Artificial Sequence
  Description of Artificial Sequence: Synthetic oligonucleotide
ugaugaggguagaguggcu

SEQ ID NO: 8181 - RNA, 19 nt, Artificial Sequence
  Description of Artificial Sequence: Synthetic oligonucleotide
gccacucuacccucaucau

SEQ ID NO: 8182 - RNA, 19 nt, Artificial Sequence
  Description of Artificial Sequence: Synthetic oligonucleotide
augaugaggguagaguggc

SEQ ID NO: 8183 - RNA, 19 nt, Artificial Sequence
  Description of Artificial Sequence: Synthetic oligonucleotide
ccacucuacccucaucaug

SEQ ID NO: 8184 - RNA, 19 nt, Artificial Sequence
  Description of Artificial Sequence: Synthetic oligonucleotide
caugaugaggguagagugg

SEQ ID NO: 8185 - RNA, 19 nt, Artificial Sequence
  Description of Artificial Sequence: Synthetic oligonucleotide
cacucuacccucaucaugc

SEQ ID NO: 8186 - RNA, 19 nt, Artificial Sequence
  Description of Artificial Sequence: Synthetic oligonucleotide
gcaugaugaggguagagug

SEQ ID NO: 8187 - RNA, 19 nt, Artificial Sequence
  Description of Artificial Sequence: Synthetic oligonucleotide
acucuacccucaucaugcc

SEQ ID NO: 8188 - RNA, 19 nt, Artificial Sequence
  Description of Artificial Sequence: Synthetic oligonucleotide
ggcaugaugaggguagagu

SEQ ID NO: 8189 - RNA, 19 nt, Artificial Sequence
  Description of Artificial Sequence: Synthetic oligonucleotide
cucuacccucaucaugccc

SEQ ID NO: 8190 - RNA, 19 nt, Artificial Sequence
  Description of Artificial Sequence: Synthetic oligonucleotide
gggcaugaugaggguagag

SEQ ID NO: 8191 - RNA, 19 nt, Artificial Sequence
  Description of Artificial Sequence: Synthetic oligonucleotide
ucuacccucaucaugcccu

SEQ ID NO: 8192 - RNA, 19 nt, Artificial Sequence
  Description of Artificial Sequence: Synthetic oligonucleotide
agggcaugaugaggguaga

SEQ ID NO: 8193 - RNA, 19 nt, Artificial Sequence
  Description of Artificial Sequence: Synthetic oligonucleotide
cuacccucaucaugcccuu

SEQ ID NO: 8194 - RNA, 19 nt, Artificial Sequence
  Description of Artificial Sequence: Synthetic oligonucleotide
aagggcaugaugaggguag

SEQ ID NO: 8195 - RNA, 19 nt, Artificial Sequence
  Description of Artificial Sequence: Synthetic oligonucleotide
uacccucaucaugcccuuu

SEQ ID NO: 8196 - RNA, 19 nt, Artificial Sequence
  Description of Artificial Sequence: Synthetic oligonucleotide
aaagggcaugaugagggua

SEQ ID NO: 8197 - RNA, 19 nt, Artificial Sequence
  Description of Artificial Sequence: Synthetic oligonucleotide
acccucaucaugcccuuua

SEQ ID NO: 8198 - RNA, 19 nt, Artificial Sequence
  Description of Artificial Sequence: Synthetic oligonucleotide
uaaagggcaugaugagggu

SEQ ID NO: 8199 - RNA, 19 nt, Artificial Sequence
  Description of Artificial Sequence: Synthetic oligonucleotide
cccucaucaugcccuuuac

SEQ ID NO: 8200 - RNA, 19 nt, Artificial Sequence
  Description of Artificial Sequence: Synthetic oligonucleotide
guaaagggcaugaugaggg

SEQ ID NO: 8201 - RNA, 19 nt, Artificial Sequence
  Description of Artificial Sequence: Synthetic oligonucleotide
cucaucaugcccuuuacac

SEQ ID NO: 8202 - RNA, 19 nt, Artificial Sequence
  Description of Artificial Sequence: Synthetic oligonucleotide
guguaaagggcaugaugag

SEQ ID NO: 8203 - RNA, 19 nt, Artificial Sequence
  Description of Artificial Sequence: Synthetic oligonucleotide
ucaucaugcccuuuacacu

SEQ ID NO: 8204 - RNA, 19 nt, Artificial Sequence
  Description of Artificial Sequence: Synthetic oligonucleotide
aguguaaagggcaugauga

SEQ ID NO: 8205 - RNA, 19 nt, Artificial Sequence
  Description of Artificial Sequence: Synthetic oligonucleotide
cccuucuugacuuuucuuc

SEQ ID NO: 8206 - RNA, 19 nt, Artificial Sequence
  Description of Artificial Sequence: Synthetic oligonucleotide
gaagaaaagucaagaaggg

SEQ ID NO: 8207 - RNA, 19 nt, Artificial Sequence
  Description of Artificial Sequence: Synthetic oligonucleotide
cuucuugacuuuucuucuc

SEQ ID NO: 8208 - RNA, 19 nt, Artificial Sequence
  Description of Artificial Sequence: Synthetic oligonucleotide
gagaagaaaagucaagaag

SEQ ID NO: 8209 - RNA, 19 nt, Artificial Sequence
  Description of Artificial Sequence: Synthetic oligonucleotide
gacuuuucuucucaacuac

SEQ ID NO: 8210 - RNA, 19 nt, Artificial Sequence
  Description of Artificial Sequence: Synthetic oligonucleotide
guaguugagaagaaaaguc

SEQ ID NO: 8211 - RNA, 19 nt, Artificial Sequence
  Description of Artificial Sequence: Synthetic oligonucleotide
acuuuucuucucaacuacc

SEQ ID NO: 8212 - RNA, 19 nt, Artificial Sequence
  Description of Artificial Sequence: Synthetic oligonucleotide
gguaguugagaagaaaagu

SEQ ID NO: 8213 - RNA, 19 nt, Artificial Sequence
  Description of Artificial Sequence: Synthetic oligonucleotide
cuuuucuucucaacuacca

SEQ ID NO: 8214 - RNA, 19 nt, Artificial Sequence
  Description of Artificial Sequence: Synthetic oligonucleotide
ugguaguugagaagaaaag

SEQ ID NO: 8215 - RNA, 19 nt, Artificial Sequence
  Description of Artificial Sequence: Synthetic oligonucleotide
uuuucuucucaacuaccag

SEQ ID NO: 8216 - RNA, 19 nt, Artificial Sequence
  Description of Artificial Sequence: Synthetic oligonucleotide
cugguaguugagaagaaaa

SEQ ID NO: 8217 - RNA, 19 nt, Artificial Sequence
  Description of Artificial Sequence: Synthetic oligonucleotide
uaucuaauauaagcucgga

SEQ ID NO: 8218 - RNA, 19 nt, Artificial Sequence
  Description of Artificial Sequence: Synthetic oligonucleotide
uccgagcuuauauuagaua

SEQ ID NO: 8219 - RNA, 19 nt, Artificial Sequence
  Description of Artificial Sequence: Synthetic oligonucleotide
aucuaauauaagcucggag

SEQ ID NO: 8220 - RNA, 19 nt, Artificial Sequence
  Description of Artificial Sequence: Synthetic oligonucleotide
cuccgagcuuauauuagau

SEQ ID NO: 8221 - RNA, 19 nt, Artificial Sequence
  Description of Artificial Sequence: Synthetic oligonucleotide
ucuaauauaagcucggagu

SEQ ID NO: 8222 - RNA, 19 nt, Artificial Sequence
  Description of Artificial Sequence: Synthetic oligonucleotide
acuccgagcuuauauuaga

SEQ ID NO: 8223 - RNA, 19 nt, Artificial Sequence
  Description of Artificial Sequence: Synthetic oligonucleotide
cuaauauaagcucggaguu

SEQ ID NO: 8224 - RNA, 19 nt, Artificial Sequence
  Description of Artificial Sequence: Synthetic oligonucleotide
aacuccgagcuuauauuag

SEQ ID NO: 8225 - RNA, 19 nt, Artificial Sequence
  Description of Artificial Sequence: Synthetic oligonucleotide
uaauauaagcucggaguuu

SEQ ID NO: 8226 - RNA, 19 nt, Artificial Sequence
  Description of Artificial Sequence: Synthetic oligonucleotide
aaacuccgagcuuauauua

SEQ ID NO: 8227 - RNA, 19 nt, Artificial Sequence
  Description of Artificial Sequence: Synthetic oligonucleotide
aauauaagcucggaguuug

SEQ ID NO: 8228 - RNA, 19 nt, Artificial Sequence
  Description of Artificial Sequence: Synthetic oligonucleotide
caaacuccgagcuuauauu

SEQ ID NO: 8229 - RNA, 19 nt, Artificial Sequence
  Description of Artificial Sequence: Synthetic oligonucleotide
auauaagcucggaguuugg

SEQ ID NO: 8230 - RNA, 19 nt, Artificial Sequence
  Description of Artificial Sequence: Synthetic oligonucleotide
ccaaacuccgagcuuauau

SEQ ID NO: 8231 - RNA, 19 nt, Artificial Sequence
  Description of Artificial Sequence: Synthetic oligonucleotide
uauaagcucggaguuugga

SEQ ID NO: 8232 - RNA, 19 nt, Artificial Sequence
  Description of Artificial Sequence: Synthetic oligonucleotide
uccaaacuccgagcuuaua

SEQ ID NO: 8233 - RNA, 19 nt, Artificial Sequence
  Description of Artificial Sequence: Synthetic oligonucleotide
auaagcucggaguuuggac

SEQ ID NO: 8234 - RNA, 19 nt, Artificial Sequence
  Description of Artificial Sequence: Synthetic oligonucleotide
guccaaacuccgagcuuau

SEQ ID NO: 8235 - RNA, 19 nt, Artificial Sequence
  Description of Artificial Sequence: Synthetic oligonucleotide
uaagcucggaguuuggacg

SEQ ID NO: 8236 - RNA, 19 nt, Artificial Sequence
  Description of Artificial Sequence: Synthetic oligonucleotide
cguccaaacuccgagcuua

SEQ ID NO: 8237 - RNA, 19 nt, Artificial Sequence
  Description of Artificial Sequence: Synthetic oligonucleotide
aagcucggaguuuggacgg

SEQ ID NO: 8238 - RNA, 19 nt, Artificial Sequence
  Description of Artificial Sequence: Synthetic oligonucleotide
ccguccaaacuccgagcuu

SEQ ID NO: 8239 - RNA, 19 nt, Artificial Sequence
  Description of Artificial Sequence: Synthetic oligonucleotide
agcucggaguuuggacgga

SEQ ID NO: 8240 - RNA, 19 nt, Artificial Sequence
  Description of Artificial Sequence: Synthetic oligonucleotide
uccguccaaacuccgagcu

SEQ ID NO: 8241 - RNA, 19 nt, Artificial Sequence
  Description of Artificial Sequence: Synthetic oligonucleotide
gcucggaguuuggacggag

SEQ ID NO: 8242 - RNA, 19 nt, Artificial Sequence
  Description of Artificial Sequence: Synthetic oligonucleotide
cuccguccaaacuccgagc

SEQ ID NO: 8243 - RNA, 19 nt, Artificial Sequence
  Description of Artificial Sequence: Synthetic oligonucleotide
cucggaguuuggacggagg

SEQ ID NO: 8244 - RNA, 19 nt, Artificial Sequence
  Description of Artificial Sequence: Synthetic oligonucleotide
ccuccguccaaacuccgag

SEQ ID NO: 8245 - RNA, 19 nt, Artificial Sequence
  Description of Artificial Sequence: Synthetic oligonucleotide
ucggaguuuggacggaggg

SEQ ID NO: 8246 - RNA, 19 nt, Artificial Sequence
  Description of Artificial Sequence: Synthetic oligonucleotide
cccuccguccaaacuccga

SEQ ID NO: 8247 - RNA, 19 nt, Artificial Sequence
  Description of Artificial Sequence: Synthetic oligonucleotide
cggaguuuggacggagggu

SEQ ID NO: 8248 - RNA, 19 nt, Artificial Sequence
  Description of Artificial Sequence: Synthetic oligonucleotide
acccuccguccaaacuccg

SEQ ID NO: 8249 - RNA, 19 nt, Artificial Sequence
  Description of Artificial Sequence: Synthetic oligonucleotide
uuuggacggagggucugga

SEQ ID NO: 8250 - RNA, 19 nt, Artificial Sequence
  Description of Artificial Sequence: Synthetic oligonucleotide
uccagacccuccguccaaa

SEQ ID NO: 8251 - RNA, 19 nt, Artificial Sequence
  Description of Artificial Sequence: Synthetic oligonucleotide
cccagcgaccuuuccgugu

SEQ ID NO: 8252 - RNA, 19 nt, Artificial Sequence
  Description of Artificial Sequence: Synthetic oligonucleotide
acacggaaaggucgcuggg

SEQ ID NO: 8253 - RNA, 19 nt, Artificial Sequence
  Description of Artificial Sequence: Synthetic oligonucleotide
ccagcgaccuuuccguguc

SEQ ID NO: 8254 - RNA, 19 nt, Artificial Sequence
  Description of Artificial Sequence: Synthetic oligonucleotide
gacacggaaaggucgcugg

SEQ ID NO: 8255 - RNA, 19 nt, Artificial Sequence
  Description of Artificial Sequence: Synthetic oligonucleotide
cagcgaccuuuccgugucu

SEQ ID NO: 8256 - RNA, 19 nt, Artificial Sequence
  Description of Artificial Sequence: Synthetic oligonucleotide
agacacggaaaggucgcug

SEQ ID NO: 8257 - RNA, 19 nt, Artificial Sequence
  Description of Artificial Sequence: Synthetic oligonucleotide
agcgaccuuuccgugucug

SEQ ID NO: 8258 - RNA, 19 nt, Artificial Sequence
  Description of Artificial Sequence: Synthetic oligonucleotide
cagacacggaaaggucgcu

SEQ ID NO: 8259 - RNA, 19 nt, Artificial Sequence
  Description of Artificial Sequence: Synthetic oligonucleotide
gcgaccuuuccgugucugu

SEQ ID NO: 8260 - RNA, 19 nt, Artificial Sequence
  Description of Artificial Sequence: Synthetic oligonucleotide
acagacacggaaaggucgc

SEQ ID NO: 8261 - RNA, 19 nt, Artificial Sequence
  Description of Artificial Sequence: Synthetic oligonucleotide
cgaccuuuccgugucugug

SEQ ID NO: 8262 - RNA, 19 nt, Artificial Sequence
  Description of Artificial Sequence: Synthetic oligonucleotide
cacagacacggaaaggucg

SEQ ID NO: 8263 - RNA, 19 nt, Artificial Sequence
  Description of Artificial Sequence: Synthetic oligonucleotide
cuuuccgugucugugauca

SEQ ID NO: 8264 - RNA, 19 nt, Artificial Sequence
  Description of Artificial Sequence: Synthetic oligonucleotide
ugaucacagacacggaaag

SEQ ID NO: 8265 - RNA, 19 nt, Artificial Sequence
  Description of Artificial Sequence: Synthetic oligonucleotide
uuuccgugucugugaucac

SEQ ID NO: 8266 - RNA, 19 nt, Artificial Sequence
  Description of Artificial Sequence: Synthetic oligonucleotide
gugaucacagacacggaaa

SEQ ID NO: 8267 - RNA, 19 nt, Artificial Sequence
  Description of Artificial Sequence: Synthetic oligonucleotide
uuccgugucugugaucaca

SEQ ID NO: 8268 - RNA, 19 nt, Artificial Sequence
  Description of Artificial Sequence: Synthetic oligonucleotide
ugugaucacagacacggaa

SEQ ID NO: 8269 - RNA, 19 nt, Artificial Sequence
  Description of Artificial Sequence: Synthetic oligonucleotide
aaggccugacagcugccac

SEQ ID NO: 8270 - RNA, 19 nt, Artificial Sequence
  Description of Artificial Sequence: Synthetic oligonucleotide
guggcagcugucaggccuu

SEQ ID NO: 8271 - RNA, 19 nt, Artificial Sequence
  Description of Artificial Sequence: Synthetic oligonucleotide
gccaggagcugcuagccaa

SEQ ID NO: 8272 - RNA, 19 nt, Artificial Sequence
  Description of Artificial Sequence: Synthetic oligonucleotide
uuggcuagcagcuccuggc

SEQ ID NO: 8273 - RNA, 19 nt, Artificial Sequence
  Description of Artificial Sequence: Synthetic oligonucleotide
ccaggagcugcuagccaaa

SEQ ID NO: 8274 - RNA, 19 nt, Artificial Sequence
  Description of Artificial Sequence: Synthetic oligonucleotide
uuuggcuagcagcuccugg

SEQ ID NO: 8275 - RNA, 19 nt, Artificial Sequence
  Description of Artificial Sequence: Synthetic oligonucleotide
gagcugcuagccaaaguaa

SEQ ID NO: 8276 - RNA, 19 nt, Artificial Sequence
  Description of Artificial Sequence: Synthetic oligonucleotide
uuacuuuggcuagcagcuc

SEQ ID NO: 8277 - RNA, 19 nt, Artificial Sequence
  Description of Artificial Sequence: Synthetic oligonucleotide
agcugcuagccaaaguaag

SEQ ID NO: 8278 - RNA, 19 nt, Artificial Sequence
  Description of Artificial Sequence: Synthetic oligonucleotide
cuuacuuuggcuagcagcu

SEQ ID NO: 8279 - RNA, 19 nt, Artificial Sequence
  Description of Artificial Sequence: Synthetic oligonucleotide
gcugcuagccaaaguaagu

SEQ ID NO: 8280 - RNA, 19 nt, Artificial Sequence
  Description of Artificial Sequence: Synthetic oligonucleotide
acuuacuuuggcuagcagc

SEQ ID NO: 8281 - RNA, 19 nt, Artificial Sequence
  Description of Artificial Sequence: Synthetic oligonucleotide
cugcuagccaaaguaagua

SEQ ID NO: 8282 - RNA, 19 nt, Artificial Sequence
  Description of Artificial Sequence: Synthetic oligonucleotide
uacuuacuuuggcuagcag

SEQ ID NO: 8283 - RNA, 19 nt, Artificial Sequence
  Description of Artificial Sequence: Synthetic oligonucleotide
ugcuagccaaaguaaguag

SEQ ID NO: 8284 - RNA, 19 nt, Artificial Sequence
  Description of Artificial Sequence: Synthetic oligonucleotide
cuacuuacuuuggcuagca

SEQ ID NO: 8285 - RNA, 19 nt, Artificial Sequence
  Description of Artificial Sequence: Synthetic oligonucleotide
gcuagccaaaguaaguagg

SEQ ID NO: 8286 - RNA, 19 nt, Artificial Sequence
  Description of Artificial Sequence: Synthetic oligonucleotide
ccuacuuacuuuggcuagc

SEQ ID NO: 8287 - RNA, 19 nt, Artificial Sequence
  Description of Artificial Sequence: Synthetic oligonucleotide
uagccaaaguaaguaggcc

SEQ ID NO: 8288 - RNA, 19 nt, Artificial Sequence
  Description of Artificial Sequence: Synthetic oligonucleotide
ggccuacuuacuuuggcua

SEQ ID NO: 8289 - RNA, 19 nt, Artificial Sequence
  Description of Artificial Sequence: Synthetic oligonucleotide
agccaaaguaaguaggcca

SEQ ID NO: 8290 - RNA, 19 nt, Artificial Sequence
  Description of Artificial Sequence: Synthetic oligonucleotide
uggccuacuuacuuuggcu

SEQ ID NO: 8291 - RNA, 19 nt, Artificial Sequence
  Description of Artificial Sequence: Synthetic oligonucleotide
gccaaaguaaguaggccaa

SEQ ID NO: 8292 - RNA, 19 nt, Artificial Sequence
  Description of Artificial Sequence: Synthetic oligonucleotide
uuggccuacuuacuuuggc

SEQ ID NO: 8293 - RNA, 19 nt, Artificial Sequence
  Description of Artificial Sequence: Synthetic oligonucleotide
ccaaaguaaguaggccaag

SEQ ID NO: 8294 - RNA, 19 nt, Artificial Sequence
  Description of Artificial Sequence: Synthetic oligonucleotide
cuuggccuacuuacuuugg

SEQ ID NO: 8295 - RNA, 19 nt, Artificial Sequence
  Description of Artificial Sequence: Synthetic oligonucleotide
caaaguaaguaggccaagu

SEQ ID NO: 8296 - RNA, 19 nt, Artificial Sequence
  Description of Artificial Sequence: Synthetic oligonucleotide
acuuggccuacuuacuuug

SEQ ID NO: 8297 - RNA, 19 nt, Artificial Sequence
  Description of Artificial Sequence: Synthetic oligonucleotide
aaaguaaguaggccaaguu

SEQ ID NO: 8298 - RNA, 19 nt, Artificial Sequence
  Description of Artificial Sequence: Synthetic oligonucleotide
aacuuggccuacuuacuuu

SEQ ID NO: 8299 - RNA, 19 nt, Artificial Sequence
  Description of Artificial Sequence: Synthetic oligonucleotide
aaguaaguaggccaaguuc

SEQ ID NO: 8300 - RNA, 19 nt, Artificial Sequence
  Description of Artificial Sequence: Synthetic oligonucleotide
gaacuuggccuacuuacuu

SEQ ID NO: 8301 - RNA, 19 nt, Artificial Sequence
  Description of Artificial Sequence: Synthetic oligonucleotide
aguaaguaggccaaguucc

SEQ ID NO: 8302 - RNA, 19 nt, Artificial Sequence
  Description of Artificial Sequence: Synthetic oligonucleotide
ggaacuuggccuacuuacu

SEQ ID NO: 8303 - RNA, 19 nt, Artificial Sequence
  Description of Artificial Sequence: Synthetic oligonucleotide
guaaguaggccaaguuccu

SEQ ID NO: 8304 - RNA, 19 nt, Artificial Sequence
  Description of Artificial Sequence: Synthetic oligonucleotide
aggaacuuggccuacuuac

SEQ ID NO: 8305 - RNA, 19 nt, Artificial Sequence
  Description of Artificial Sequence: Synthetic oligonucleotide
uaaguaggccaaguuccuc

SEQ ID NO: 8306 - RNA, 19 nt, Artificial Sequence
  Description of Artificial Sequence: Synthetic oligonucleotide
gaggaacuuggccuacuua

SEQ ID NO: 8307 - RNA, 19 nt, Artificial Sequence
  Description of Artificial Sequence: Synthetic oligonucleotide
uaggccaaguuccucgguu

SEQ ID NO: 8308 - RNA, 19 nt, Artificial Sequence
  Description of Artificial Sequence: Synthetic oligonucleotide
aaccgaggaacuuggccua

SEQ ID NO: 8309 - RNA, 19 nt, Artificial Sequence
  Description of Artificial Sequence: Synthetic oligonucleotide
aggccaaguuccucgguuc

SEQ ID NO: 8310 - RNA, 19 nt, Artificial Sequence
  Description of Artificial Sequence: Synthetic oligonucleotide
gaaccgaggaacuuggccu

SEQ ID NO: 8311 - RNA, 19 nt, Artificial Sequence
  Description of Artificial Sequence: Synthetic oligonucleotide
ggccaaguuccucgguucc

SEQ ID NO: 8312 - RNA, 19 nt, Artificial Sequence
  Description of Artificial Sequence: Synthetic oligonucleotide
ggaaccgaggaacuuggcc

SEQ ID NO: 8313 - RNA, 19 nt, Artificial Sequence
  Description of Artificial Sequence: Synthetic oligonucleotide
gccaaguuccucgguuccu

SEQ ID NO: 8314 - RNA, 19 nt, Artificial Sequence
  Description of Artificial Sequence: Synthetic oligonucleotide
aggaaccgaggaacuuggc

SEQ ID NO: 8315 - RNA, 19 nt, Artificial Sequence
  Description of Artificial Sequence: Synthetic oligonucleotide
ccaaguuccucgguuccua

SEQ ID NO: 8316 - RNA, 19 nt, Artificial Sequence
  Description of Artificial Sequence: Synthetic oligonucleotide
uaggaaccgaggaacuugg

SEQ ID NO: 8317 - RNA, 19 nt, Artificial Sequence
  Description of Artificial Sequence: Synthetic oligonucleotide
caaguuccucgguuccuau

SEQ ID NO: 8318 - RNA, 19 nt, Artificial Sequence
  Description of Artificial Sequence: Synthetic oligonucleotide
auaggaaccgaggaacuug

SEQ ID NO: 8319 - RNA, 19 nt, Artificial Sequence
  Description of Artificial Sequence: Synthetic oligonucleotide
aaguuccucgguuccuaua

SEQ ID NO: 8320 - RNA, 19 nt, Artificial Sequence
  Description of Artificial Sequence: Synthetic oligonucleotide
uauaggaaccgaggaacuu

SEQ ID NO: 8321 - RNA, 19 nt, Artificial Sequence
  Description of Artificial Sequence: Synthetic oligonucleotide
aguuccucgguuccuauag

SEQ ID NO: 8322 - RNA, 19 nt, Artificial Sequence
  Description of Artificial Sequence: Synthetic oligonucleotide
cuauaggaaccgaggaacu

SEQ ID NO: 8323 - RNA, 19 nt, Artificial Sequence
  Description of Artificial Sequence: Synthetic oligonucleotide
guuccucgguuccuauagc

SEQ ID NO: 8324 - RNA, 19 nt, Artificial Sequence
  Description of Artificial Sequence: Synthetic oligonucleotide
gcuauaggaaccgaggaac

SEQ ID NO: 8325 - RNA, 19 nt, Artificial Sequence
  Description of Artificial Sequence: Synthetic oligonucleotide
uuccucgguuccuauagca

SEQ ID NO: 8326 - RNA, 19 nt, Artificial Sequence
  Description of Artificial Sequence: Synthetic oligonucleotide
ugcuauaggaaccgaggaa

SEQ ID NO: 8327 - RNA, 19 nt, Artificial Sequence
  Description of Artificial Sequence: Synthetic oligonucleotide
uccucgguuccuauagcag

SEQ ID NO: 8328 - RNA, 19 nt, Artificial Sequence
  Description of Artificial Sequence: Synthetic oligonucleotide
cugcuauaggaaccgagga

SEQ ID NO: 8329 - RNA, 19 nt, Artificial Sequence
  Description of Artificial Sequence: Synthetic oligonucleotide
caguggcaacuugugauga

SEQ ID NO: 8330 - RNA, 19 nt, Artificial Sequence
  Description of Artificial Sequence: Synthetic oligonucleotide
ucaucacaaguugccacug

SEQ ID NO: 8331 - RNA, 19 nt, Artificial Sequence
  Description of Artificial Sequence: Synthetic oligonucleotide
aguggcaacuugugaugau

SEQ ID NO: 8332 - RNA, 19 nt, Artificial Sequence
  Description of Artificial Sequence: Synthetic oligonucleotide
aucaucacaaguugccacu

SEQ ID NO: 8333 - RNA, 19 nt, Artificial Sequence
  Description of Artificial Sequence: Synthetic oligonucleotide
guggcaacuugugaugaug

SEQ ID NO: 8334 - RNA, 19 nt, Artificial Sequence
  Description of Artificial Sequence: Synthetic oligonucleotide
caucaucacaaguugccac

SEQ ID NO: 8335 - RNA, 19 nt, Artificial Sequence
  Description of Artificial Sequence: Synthetic oligonucleotide
ggcaacuugugaugaugga

SEQ ID NO: 8336 - RNA, 19 nt, Artificial Sequence
  Description of Artificial Sequence: Synthetic oligonucleotide
uccaucaucacaaguugcc

SEQ ID NO: 8337 - RNA, 19 nt, Artificial Sequence
  Description of Artificial Sequence: Synthetic oligonucleotide
acuugugaugauggagcag

SEQ ID NO: 8338 - RNA, 19 nt, Artificial Sequence
  Description of Artificial Sequence: Synthetic oligonucleotide
cugcuccaucaucacaagu

SEQ ID NO: 8339 - RNA, 19 nt, Artificial Sequence
  Description of Artificial Sequence: Synthetic oligonucleotide
cuugugaugauggagcaga

SEQ ID NO: 8340 - RNA, 19 nt, Artificial Sequence
  Description of Artificial Sequence: Synthetic oligonucleotide
ucugcuccaucaucacaag

SEQ ID NO: 8341 - RNA, 19 nt, Artificial Sequence
  Description of Artificial Sequence: Synthetic oligonucleotide
gugaugauggagcagaggg

SEQ ID NO: 8342 - RNA, 19 nt, Artificial Sequence
  Description of Artificial Sequence: Synthetic oligonucleotide
cccucugcuccaucaucac

SEQ ID NO: 8343 - RNA, 19 nt, Artificial Sequence
  Description of Artificial Sequence: Synthetic oligonucleotide
ugaugauggagcagagggc

SEQ ID NO: 8344 - RNA, 19 nt, Artificial Sequence
  Description of Artificial Sequence: Synthetic oligonucleotide
gcccucugcuccaucauca

SEQ ID NO: 8345 - RNA, 19 nt, Artificial Sequence
  Description of Artificial Sequence: Synthetic oligonucleotide
uggagcagagggcugaagu

SEQ ID NO: 8346 - RNA, 19 nt, Artificial Sequence
  Description of Artificial Sequence: Synthetic oligonucleotide
acuucagcccucugcucca

SEQ ID NO: 8347 - RNA, 19 nt, Artificial Sequence
  Description of Artificial Sequence: Synthetic oligonucleotide
ggagcagagggcugaaguc

SEQ ID NO: 8348 - RNA, 19 nt, Artificial Sequence
  Description of Artificial Sequence: Synthetic oligonucleotide
gacuucagcccucugcucc

SEQ ID NO: 8349 - RNA, 19 nt, Artificial Sequence
  Description of Artificial Sequence: Synthetic oligonucleotide
gagcagagggcugaaguca

SEQ ID NO: 8350 - RNA, 19 nt, Artificial Sequence
  Description of Artificial Sequence: Synthetic oligonucleotide
ugacuucagcccucugcuc

SEQ ID NO: 8351 - RNA, 19 nt, Artificial Sequence
  Description of Artificial Sequence: Synthetic oligonucleotide
cuaaaagcagcggaguggg

SEQ ID NO: 8352 - RNA, 19 nt, Artificial Sequence
  Description of Artificial Sequence: Synthetic oligonucleotide
cccacuccgcugcuuuuag

SEQ ID NO: 8353 - RNA, 19 nt, Artificial Sequence
  Description of Artificial Sequence: Synthetic oligonucleotide
uaaaagcagcggagugggc

SEQ ID NO: 8354 - RNA, 19 nt, Artificial Sequence
  Description of Artificial Sequence: Synthetic oligonucleotide
gcccacuccgcugcuuuua

SEQ ID NO: 8355 - RNA, 19 nt, Artificial Sequence
  Description of Artificial Sequence: Synthetic oligonucleotide
aaaagcagcggagugggcc

SEQ ID NO: 8356 - RNA, 19 nt, Artificial Sequence
  Description of Artificial Sequence: Synthetic oligonucleotide
ggcccacuccgcugcuuuu

SEQ ID NO: 8357 - RNA, 19 nt, Artificial Sequence
  Description of Artificial Sequence: Synthetic oligonucleotide
aaagcagcggagugggccu

SEQ ID NO: 8358 - RNA, 19 nt, Artificial Sequence
  Description of Artificial Sequence: Synthetic oligonucleotide
aggcccacuccgcugcuuu

SEQ ID NO: 8359 - RNA, 19 nt, Artificial Sequence
  Description of Artificial Sequence: Synthetic oligonucleotide
aagcagcggagugggccua

SEQ ID NO: 8360 - RNA, 19 nt, Artificial Sequence
  Description of Artificial Sequence: Synthetic oligonucleotide
uaggcccacuccgcugcuu

SEQ ID NO: 8361 - RNA, 19 nt, Artificial Sequence
  Description of Artificial Sequence: Synthetic oligonucleotide
agcagcggagugggccuaa

SEQ ID NO: 8362 - RNA, 19 nt, Artificial Sequence
  Description of Artificial Sequence: Synthetic oligonucleotide
uuaggcccacuccgcugcu

SEQ ID NO: 8363 - RNA, 19 nt, Artificial Sequence
  Description of Artificial Sequence: Synthetic oligonucleotide
gcagcggagugggccuaau

SEQ ID NO: 8364 - RNA, 19 nt, Artificial Sequence
  Description of Artificial Sequence: Synthetic oligonucleotide
auuaggcccacuccgcugc

SEQ ID NO: 8365 - RNA, 19 nt, Artificial Sequence
  Description of Artificial Sequence: Synthetic oligonucleotide
cagcggagugggccuaaug

SEQ ID NO: 8366 - RNA, 19 nt, Artificial Sequence
  Description of Artificial Sequence: Synthetic oligonucleotide
cauuaggcccacuccgcug

SEQ ID NO: 8367 - RNA, 19 nt, Artificial Sequence
  Description of Artificial Sequence: Synthetic oligonucleotide
agcggagugggccuaauga

SEQ ID NO: 8368 - RNA, 19 nt, Artificial Sequence
  Description of Artificial Sequence: Synthetic oligonucleotide
ucauuaggcccacuccgcu

SEQ ID NO: 8369 - RNA, 19 nt, Artificial Sequence
  Description of Artificial Sequence: Synthetic oligonucleotide
gcggagugggccuaaugag

SEQ ID NO: 8370 - RNA, 19 nt, Artificial Sequence
  Description of Artificial Sequence: Synthetic oligonucleotide
cucauuaggcccacuccgc

SEQ ID NO: 8371 - RNA, 19 nt, Artificial Sequence
  Description of Artificial Sequence: Synthetic oligonucleotide
agugggccuaaugagcucu

SEQ ID NO: 8372 - RNA, 19 nt, Artificial Sequence
  Description of Artificial Sequence: Synthetic oligonucleotide
agagcucauuaggcccacu

SEQ ID NO: 8373 - RNA, 19 nt, Artificial Sequence
  Description of Artificial Sequence: Synthetic oligonucleotide
gugggccuaaugagcucug

SEQ ID NO: 8374 - RNA, 19 nt, Artificial Sequence
  Description of Artificial Sequence: Synthetic oligonucleotide
cagagcucauuaggcccac

SEQ ID NO: 8375 - RNA, 19 nt, Artificial Sequence
  Description of Artificial Sequence: Synthetic oligonucleotide
ugggccuaaugagcucugg

SEQ ID NO: 8376 - RNA, 19 nt, Artificial Sequence
  Description of Artificial Sequence: Synthetic oligonucleotide
ccagagcucauuaggccca

SEQ ID NO: 8377 - RNA, 19 nt, Artificial Sequence
  Description of Artificial Sequence: Synthetic oligonucleotide
gggccuaaugagcucuggu

SEQ ID NO: 8378 - RNA, 19 nt, Artificial Sequence
  Description of Artificial Sequence: Synthetic oligonucleotide
accagagcucauuaggccc

SEQ ID NO: 8379 - RNA, 19 nt, Artificial Sequence
  Description of Artificial Sequence: Synthetic oligonucleotide
ggccuaaugagcucugguc

SEQ ID NO: 8380 - RNA, 19 nt, Artificial Sequence
  Description of Artificial Sequence: Synthetic oligonucleotide
gaccagagcucauuaggcc

SEQ ID NO: 8381 - RNA, 19 nt, Artificial Sequence
  Description of Artificial Sequence: Synthetic oligonucleotide
gccuaaugagcucugguca

SEQ ID NO: 8382 - RNA, 19 nt, Artificial Sequence
  Description of Artificial Sequence: Synthetic oligonucleotide
ugaccagagcucauuaggc

SEQ ID NO: 8383 - RNA, 19 nt, Artificial Sequence
  Description of Artificial Sequence: Synthetic oligonucleotide
ccuaaugagcucuggucaa

SEQ ID NO: 8384 - RNA, 19 nt, Artificial Sequence
  Description of Artificial Sequence: Synthetic oligonucleotide
uugaccagagcucauuagg

SEQ ID NO: 8385 - RNA, 19 nt, Artificial Sequence
  Description of Artificial Sequence: Synthetic oligonucleotide
cuaaugagcucuggucaau

SEQ ID NO: 8386 - RNA, 19 nt, Artificial Sequence
  Description of Artificial Sequence: Synthetic oligonucleotide
auugaccagagcucauuag

SEQ ID NO: 8387 - RNA, 19 nt, Artificial Sequence
  Description of Artificial Sequence: Synthetic oligonucleotide
uaaugagcucuggucaauu

SEQ ID NO: 8388 - RNA, 19 nt, Artificial Sequence
  Description of Artificial Sequence: Synthetic oligonucleotide
aauugaccagagcucauua

SEQ ID NO: 8389 - RNA, 19 nt, Artificial Sequence
  Description of Artificial Sequence: Synthetic oligonucleotide
aaugagcucuggucaauuu

SEQ ID NO: 8390 - RNA, 19 nt, Artificial Sequence
  Description of Artificial Sequence: Synthetic oligonucleotide
aaauugaccagagcucauu

SEQ ID NO: 8391 - RNA, 19 nt, Artificial Sequence
  Description of Artificial Sequence: Synthetic oligonucleotide
augagcucuggucaauuug

SEQ ID NO: 8392 - RNA, 19 nt, Artificial Sequence
  Description of Artificial Sequence: Synthetic oligonucleotide
caaauugaccagagcucau

SEQ ID NO: 8393 - RNA, 19 nt, Artificial Sequence
  Description of Artificial Sequence: Synthetic oligonucleotide
ugagcucuggucaauuugu

SEQ ID NO: 8394 - RNA, 19 nt, Artificial Sequence
  Description of Artificial Sequence: Synthetic oligonucleotide
acaaauugaccagagcuca

SEQ ID NO: 8395 - RNA, 19 nt, Artificial Sequence
  Description of Artificial Sequence: Synthetic oligonucleotide
cuggucaauuuguucauuu

SEQ ID NO: 8396 - RNA, 19 nt, Artificial Sequence
  Description of Artificial Sequence: Synthetic oligonucleotide
aaaugaacaaauugaccag

SEQ ID NO: 8397 - RNA, 19 nt, Artificial Sequence
  Description of Artificial Sequence: Synthetic oligonucleotide
caauuuguucauuuuccac

SEQ ID NO: 8398 - RNA, 19 nt, Artificial Sequence
  Description of Artificial Sequence: Synthetic oligonucleotide
guggaaaaugaacaaauug

SEQ ID NO: 8399 - RNA, 19 nt, Artificial Sequence
  Description of Artificial Sequence: Synthetic oligonucleotide
agugagcuuuucuauggga

SEQ ID NO: 8400 - RNA, 19 nt, Artificial Sequence
  Description of Artificial Sequence: Synthetic oligonucleotide
ucccauagaaaagcucacu

SEQ ID NO: 8401 - RNA, 19 nt, Artificial Sequence
  Description of Artificial Sequence: Synthetic oligonucleotide
agcuuuucuaugggagcag

SEQ ID NO: 8402 - RNA, 19 nt, Artificial Sequence
  Description of Artificial Sequence: Synthetic oligonucleotide
cugcucccauagaaaagcu

SEQ ID NO: 8403 - RNA, 19 nt, Artificial Sequence
  Description of Artificial Sequence: Synthetic oligonucleotide
gaauucagaagcuaguaug

SEQ ID NO: 8404 - RNA, 19 nt, Artificial Sequence
  Description of Artificial Sequence: Synthetic oligonucleotide
cauacuagcuucugaauuc

SEQ ID NO: 8405 - RNA, 19 nt, Artificial Sequence
  Description of Artificial Sequence: Synthetic oligonucleotide
auucagaagcuaguaugga

SEQ ID NO: 8406 - RNA, 19 nt, Artificial Sequence
  Description of Artificial Sequence: Synthetic oligonucleotide
uccauacuagcuucugaau

SEQ ID NO: 8407 - RNA, 19 nt, Artificial Sequence
  Description of Artificial Sequence: Synthetic oligonucleotide
uucagaagcuaguauggaa

SEQ ID NO: 8408 - RNA, 19 nt, Artificial Sequence
  Description of Artificial Sequence: Synthetic oligonucleotide
uuccauacuagcuucugaa

SEQ ID NO: 8409 - RNA, 19 nt, Artificial Sequence
  Description of Artificial Sequence: Synthetic oligonucleotide
aaaggugauuugugugaca

SEQ ID NO: 8410 - RNA, 19 nt, Artificial Sequence
  Description of Artificial Sequence: Synthetic oligonucleotide
ugucacacaaaucaccuuu

SEQ ID NO: 8411 - RNA, 19 nt, Artificial Sequence
  Description of Artificial Sequence: Synthetic oligonucleotide
auucugauucugccacuuc

SEQ ID NO: 8412 - RNA, 19 nt, Artificial Sequence
  Description of Artificial Sequence: Synthetic oligonucleotide
gaaguggcagaaucagaau

SEQ ID NO: 8413 - RNA, 19 nt, Artificial Sequence
  Description of Artificial Sequence: Synthetic oligonucleotide
auucugccacuuccugccu

SEQ ID NO: 8414 - RNA, 19 nt, Artificial Sequence
  Description of Artificial Sequence: Synthetic oligonucleotide
aggcaggaaguggcagaau

SEQ ID NO: 8415 - RNA, 19 nt, Artificial Sequence
  Description of Artificial Sequence: Synthetic oligonucleotide
gccacuuccugccugucaa

SEQ ID NO: 8416 - RNA, 19 nt, Artificial Sequence
  Description of Artificial Sequence: Synthetic oligonucleotide
uugacaggcaggaaguggc

SEQ ID NO: 8417 - RNA, 19 nt, Artificial Sequence
  Description of Artificial Sequence: Synthetic oligonucleotide
ccacuuccugccugucaaa

SEQ ID NO: 8418 - RNA, 19 nt, Artificial Sequence
  Description of Artificial Sequence: Synthetic oligonucleotide
uuugacaggcaggaagugg

SEQ ID NO: 8419 - RNA, 19 nt, Artificial Sequence
  Description of Artificial Sequence: Synthetic oligonucleotide
aaccuugggaaguuguuca

SEQ ID NO: 8420 - RNA, 19 nt, Artificial Sequence
  Description of Artificial Sequence: Synthetic oligonucleotide
ugaacaacuucccaagguu

SEQ ID NO: 8421 - RNA, 19 nt, Artificial Sequence
  Description of Artificial Sequence: Synthetic oligonucleotide
accuugggaaguuguucaa

SEQ ID NO: 8422 - RNA, 19 nt, Artificial Sequence
  Description of Artificial Sequence: Synthetic oligonucleotide
uugaacaacuucccaaggu

SEQ ID NO: 8423 - RNA, 19 nt, Artificial Sequence
  Description of Artificial Sequence: Synthetic oligonucleotide
ccuugggaaguuguucaac

SEQ ID NO: 8424 - RNA, 19 nt, Artificial Sequence
  Description of Artificial Sequence: Synthetic oligonucleotide
guugaacaacuucccaagg

SEQ ID NO: 8425 - RNA, 19 nt, Artificial Sequence
  Description of Artificial Sequence: Synthetic oligonucleotide
gggaaguuguucaaccuac

SEQ ID NO: 8426 - RNA, 19 nt, Artificial Sequence
  Description of Artificial Sequence: Synthetic oligonucleotide
guagguugaacaacuuccc

SEQ ID NO: 8427 - RNA, 19 nt, Artificial Sequence
  Description of Artificial Sequence: Synthetic oligonucleotide
ggaaguuguucaaccuacc

SEQ ID NO: 8428 - RNA, 19 nt, Artificial Sequence
  Description of Artificial Sequence: Synthetic oligonucleotide
gguagguugaacaacuucc

SEQ ID NO: 8429 - RNA, 19 nt, Artificial Sequence
  Description of Artificial Sequence: Synthetic oligonucleotide
gaaguuguucaaccuacca

SEQ ID NO: 8430 - RNA, 19 nt, Artificial Sequence
  Description of Artificial Sequence: Synthetic oligonucleotide
ugguagguugaacaacuuc

SEQ ID NO: 8431 - RNA, 19 nt, Artificial Sequence
  Description of Artificial Sequence: Synthetic oligonucleotide
aaguuguucaaccuaccaa

SEQ ID NO: 8432 - RNA, 19 nt, Artificial Sequence
  Description of Artificial Sequence: Synthetic oligonucleotide
uugguagguugaacaacuu

SEQ ID NO: 8433 - RNA, 19 nt, Artificial Sequence
  Description of Artificial Sequence: Synthetic oligonucleotide
aguuguucaaccuaccaaa

SEQ ID NO: 8434 - RNA, 19 nt, Artificial Sequence
  Description of Artificial Sequence: Synthetic oligonucleotide
uuugguagguugaacaacu

SEQ ID NO: 8435 - RNA, 19 nt, Artificial Sequence
  Description of Artificial Sequence: Synthetic oligonucleotide
guuguucaaccuaccaaaa

SEQ ID NO: 8436 - RNA, 19 nt, Artificial Sequence
  Description of Artificial Sequence: Synthetic oligonucleotide
uuuugguagguugaacaac

SEQ ID NO: 8437 - RNA, 19 nt, Artificial Sequence
  Description of Artificial Sequence: Synthetic oligonucleotide
gcaauaauaauacaucacc

SEQ ID NO: 8438 - RNA, 19 nt, Artificial Sequence
  Description of Artificial Sequence: Synthetic oligonucleotide
ggugauguauuauuauugc

SEQ ID NO: 8439 - RNA, 19 nt, Artificial Sequence
  Description of Artificial Sequence: Synthetic oligonucleotide
auaauaauacaucaccucc

SEQ ID NO: 8440 - RNA, 19 nt, Artificial Sequence
  Description of Artificial Sequence: Synthetic oligonucleotide
ggaggugauguauuauuau

SEQ ID NO: 8441 - RNA, 19 nt, Artificial Sequence
  Description of Artificial Sequence: Synthetic oligonucleotide
uaauacaucaccuccuagg

SEQ ID NO: 8442 - RNA, 19 nt, Artificial Sequence
  Description of Artificial Sequence: Synthetic oligonucleotide
ccuaggaggugauguauua

SEQ ID NO: 8443 - RNA, 19 nt, Artificial Sequence
  Description of Artificial Sequence: Synthetic oligonucleotide
aauacaucaccuccuaggg

SEQ ID NO: 8444 - RNA, 19 nt, Artificial Sequence
  Description of Artificial Sequence: Synthetic oligonucleotide
cccuaggaggugauguauu

SEQ ID NO: 8445 - RNA, 19 nt, Artificial Sequence
  Description of Artificial Sequence: Synthetic oligonucleotide
auacaucaccuccuagggu

SEQ ID NO: 8446 - RNA, 19 nt, Artificial Sequence
  Description of Artificial Sequence: Synthetic oligonucleotide
acccuaggaggugauguau

SEQ ID NO: 8447 - RNA, 19 nt, Artificial Sequence
  Description of Artificial Sequence: Synthetic oligonucleotide
uacaucaccuccuaggguu

SEQ ID NO: 8448 - RNA, 19 nt, Artificial Sequence
  Description of Artificial Sequence: Synthetic oligonucleotide
aacccuaggaggugaugua

SEQ ID NO: 8449 - RNA, 19 nt, Artificial Sequence
  Description of Artificial Sequence: Synthetic oligonucleotide
acaucaccuccuaggguug

SEQ ID NO: 8450 - RNA, 19 nt, Artificial Sequence
  Description of Artificial Sequence: Synthetic oligonucleotide
caacccuaggaggugaugu

SEQ ID NO: 8451 - RNA, 19 nt, Artificial Sequence
  Description of Artificial Sequence: Synthetic oligonucleotide
aaaggaguaagaggauaau

SEQ ID NO: 8452 - RNA, 19 nt, Artificial Sequence
  Description of Artificial Sequence: Synthetic oligonucleotide
auuauccucuuacuccuuu

SEQ ID NO: 8453 - RNA, 19 nt, Artificial Sequence
  Description of Artificial Sequence: Synthetic oligonucleotide
aaggaguaagaggauaaug

SEQ ID NO: 8454 - RNA, 19 nt, Artificial Sequence
  Description of Artificial Sequence: Synthetic oligonucleotide
cauuauccucuuacuccuu

SEQ ID NO: 8455 - RNA, 19 nt, Artificial Sequence
  Description of Artificial Sequence: Synthetic oligonucleotide
aguaagaggauaauguagg

SEQ ID NO: 8456 - RNA, 19 nt, Artificial Sequence
  Description of Artificial Sequence: Synthetic oligonucleotide
ccuacauuauccucuuacu

SEQ ID NO: 8457 - RNA, 19 nt, Artificial Sequence
  Description of Artificial Sequence: Synthetic oligonucleotide
guaagaggauaauguaggu

SEQ ID NO: 8458 - RNA, 19 nt, Artificial Sequence
  Description of Artificial Sequence: Synthetic oligonucleotide
accuacauuauccucuuac

SEQ ID NO: 8459 - RNA, 19 nt, Artificial Sequence
  Description of Artificial Sequence: Synthetic oligonucleotide
uaagaggauaauguaggua

SEQ ID NO: 8460 - RNA, 19 nt, Artificial Sequence
  Description of Artificial Sequence: Synthetic oligonucleotide
uaccuacauuauccucuua

SEQ ID NO: 8461 - RNA, 19 nt, Artificial Sequence
  Description of Artificial Sequence: Synthetic oligonucleotide
aagaggauaauguagguaa

SEQ ID NO: 8462 - RNA, 19 nt, Artificial Sequence
  Description of Artificial Sequence: Synthetic oligonucleotide
uuaccuacauuauccucuu

SEQ ID NO: 8463 - RNA, 19 nt, Artificial Sequence
  Description of Artificial Sequence: Synthetic oligonucleotide
agaggauaauguagguaaa

SEQ ID NO: 8464 - RNA, 19 nt, Artificial Sequence
  Description of Artificial Sequence: Synthetic oligonucleotide
uuuaccuacauuauccucu

SEQ ID NO: 8465 - RNA, 19 nt, Artificial Sequence
  Description of Artificial Sequence: Synthetic oligonucleotide
gaggauaauguagguaaag

SEQ ID NO: 8466 - RNA, 19 nt, Artificial Sequence
  Description of Artificial Sequence: Synthetic oligonucleotide
cuuuaccuacauuauccuc

SEQ ID NO: 8467 - RNA, 19 nt, Artificial Sequence
  Description of Artificial Sequence: Synthetic oligonucleotide
ggauaauguagguaaaguc

SEQ ID NO: 8468 - RNA, 19 nt, Artificial Sequence
  Description of Artificial Sequence: Synthetic oligonucleotide
gacuuuaccuacauuaucc

SEQ ID NO: 8469 - RNA, 19 nt, Artificial Sequence
  Description of Artificial Sequence: Synthetic oligonucleotide
auaauguagguaaaguccu

SEQ ID NO: 8470 - RNA, 19 nt, Artificial Sequence
  Description of Artificial Sequence: Synthetic oligonucleotide
aggacuuuaccuacauuau

SEQ ID NO: 8471 - RNA, 19 nt, Artificial Sequence
  Description of Artificial Sequence: Synthetic oligonucleotide
guagguaaaguccucauac

SEQ ID NO: 8472 - RNA, 19 nt, Artificial Sequence
  Description of Artificial Sequence: Synthetic oligonucleotide
guaugaggacuuuaccuac

SEQ ID NO: 8473 - RNA, 19 nt, Artificial Sequence
  Description of Artificial Sequence: Synthetic oligonucleotide
guaaaguccucauaccugg

SEQ ID NO: 8474 - RNA, 19 nt, Artificial Sequence
  Description of Artificial Sequence: Synthetic oligonucleotide
ccagguaugaggacuuuac

SEQ ID NO: 8475 - RNA, 19 nt, Artificial Sequence
  Description of Artificial Sequence: Synthetic oligonucleotide
uaaaguccucauaccuggc

SEQ ID NO: 8476 - RNA, 19 nt, Artificial Sequence
  Description of Artificial Sequence: Synthetic oligonucleotide
gccagguaugaggacuuua

SEQ ID NO: 8477 - RNA, 19 nt, Artificial Sequence
  Description of Artificial Sequence: Synthetic oligonucleotide
aaaguccucauaccuggca

SEQ ID NO: 8478 - RNA, 19 nt, Artificial Sequence
  Description of Artificial Sequence: Synthetic oligonucleotide
ugccagguaugaggacuuu

SEQ ID NO: 8479 - RNA, 19 nt, Artificial Sequence
  Description of Artificial Sequence: Synthetic oligonucleotide
aaguccucauaccuggcac

SEQ ID NO: 8480 - RNA, 19 nt, Artificial Sequence
  Description of Artificial Sequence: Synthetic oligonucleotide
gugccagguaugaggacuu

SEQ ID NO: 8481 - RNA, 19 nt, Artificial Sequence
  Description of Artificial Sequence: Synthetic oligonucleotide
aguccucauaccuggcaca

SEQ ID NO: 8482 - RNA, 19 nt, Artificial Sequence
  Description of Artificial Sequence: Synthetic oligonucleotide
ugugccagguaugaggacu

SEQ ID NO: 8483 - RNA, 19 nt, Artificial Sequence
  Description of Artificial Sequence: Synthetic oligonucleotide
guccucauaccuggcacag

SEQ ID NO: 8484 - RNA, 19 nt, Artificial Sequence
  Description of Artificial Sequence: Synthetic oligonucleotide
cugugccagguaugaggac

SEQ ID NO: 8485 - RNA, 19 nt, Artificial Sequence
  Description of Artificial Sequence: Synthetic oligonucleotide
uccucauaccuggcacaga

SEQ ID NO: 8486 - RNA, 19 nt, Artificial Sequence
  Description of Artificial Sequence: Synthetic oligonucleotide
ucugugccagguaugagga

SEQ ID NO: 8487 - RNA, 19 nt, Artificial Sequence
  Description of Artificial Sequence: Synthetic oligonucleotide
ucuugagggugugggaagu

SEQ ID NO: 8488 - RNA, 19 nt, Artificial Sequence
  Description of Artificial Sequence: Synthetic oligonucleotide
acuucccacacccucaaga

SEQ ID NO: 8489 - RNA, 19 nt, Artificial Sequence
  Description of Artificial Sequence: Synthetic oligonucleotide
cuugagggugugggaagug

SEQ ID NO: 8490 - RNA, 19 nt, Artificial Sequence
  Description of Artificial Sequence: Synthetic oligonucleotide
cacuucccacacccucaag

SEQ ID NO: 8491 - RNA, 19 nt, Artificial Sequence
  Description of Artificial Sequence: Synthetic oligonucleotide
uugagggugugggaaguga

SEQ ID NO: 8492 - RNA, 19 nt, Artificial Sequence
  Description of Artificial Sequence: Synthetic oligonucleotide
ucacuucccacacccucaa

SEQ ID NO: 8493 - RNA, 19 nt, Artificial Sequence
  Description of Artificial Sequence: Synthetic oligonucleotide
ugagggugugggaagugag

SEQ ID NO: 8494 - RNA, 19 nt, Artificial Sequence
  Description of Artificial Sequence: Synthetic oligonucleotide
cucacuucccacacccuca

SEQ ID NO: 8495 - RNA, 19 nt, Artificial Sequence
  Description of Artificial Sequence: Synthetic oligonucleotide
agggugugggaagugaggu

SEQ ID NO: 8496 - RNA, 19 nt, Artificial Sequence
  Description of Artificial Sequence: Synthetic oligonucleotide
accucacuucccacacccu

SEQ ID NO: 8497 - RNA, 19 nt, Artificial Sequence
  Description of Artificial Sequence: Synthetic oligonucleotide
gggugugggaagugaggug

SEQ ID NO: 8498 - RNA, 19 nt, Artificial Sequence
  Description of Artificial Sequence: Synthetic oligonucleotide
caccucacuucccacaccc

SEQ ID NO: 8499 - RNA, 19 nt, Artificial Sequence
  Description of Artificial Sequence: Synthetic oligonucleotide
gggaagugaggugcagcau

SEQ ID NO: 8500 - RNA, 19 nt, Artificial Sequence
  Description of Artificial Sequence: Synthetic oligonucleotide
augcugcaccucacuuccc

SEQ ID NO: 8501 - RNA, 19 nt, Artificial Sequence
  Description of Artificial Sequence: Synthetic oligonucleotide
ggaagugaggugcagcauu

SEQ ID NO: 8502 - RNA, 19 nt, Artificial Sequence
  Description of Artificial Sequence: Synthetic oligonucleotide
aaugcugcaccucacuucc

SEQ ID NO: 8503 - RNA, 19 nt, Artificial Sequence
  Description of Artificial Sequence: Synthetic oligonucleotide
gaagugaggugcagcauug

SEQ ID NO: 8504 - RNA, 19 nt, Artificial Sequence
  Description of Artificial Sequence: Synthetic oligonucleotide
caaugcugcaccucacuuc

SEQ ID NO: 8505 - RNA, 19 nt, Artificial Sequence
  Description of Artificial Sequence: Synthetic oligonucleotide
aagugaggugcagcauugu

SEQ ID NO: 8506 - RNA, 19 nt, Artificial Sequence
  Description of Artificial Sequence: Synthetic oligonucleotide
acaaugcugcaccucacuu

SEQ ID NO: 8507 - RNA, 19 nt, Artificial Sequence
  Description of Artificial Sequence: Synthetic oligonucleotide
agugaggugcagcauugua

SEQ ID NO: 8508 - RNA, 19 nt, Artificial Sequence
  Description of Artificial Sequence: Synthetic oligonucleotide
uacaaugcugcaccucacu

SEQ ID NO: 8509 - RNA, 19 nt, Artificial Sequence
  Description of Artificial Sequence: Synthetic oligonucleotide
gugaggugcagcauuguag

SEQ ID NO: 8510 - RNA, 19 nt, Artificial Sequence
  Description of Artificial Sequence: Synthetic oligonucleotide
cuacaaugcugcaccucac

SEQ ID NO: 8511 - RNA, 19 nt, Artificial Sequence
  Description of Artificial Sequence: Synthetic oligonucleotide
ugaggugcagcauuguaga

SEQ ID NO: 8512 - RNA, 19 nt, Artificial Sequence
  Description of Artificial Sequence: Synthetic oligonucleotide
ucuacaaugcugcaccuca

SEQ ID NO: 8513 - RNA, 19 nt, Artificial Sequence
  Description of Artificial Sequence: Synthetic oligonucleotide
gaggugcagcauuguagau

SEQ ID NO: 8514 - RNA, 19 nt, Artificial Sequence
  Description of Artificial Sequence: Synthetic oligonucleotide
aucuacaaugcugcaccuc

SEQ ID NO: 8515 - RNA, 19 nt, Artificial Sequence
  Description of Artificial Sequence: Synthetic oligonucleotide
aggugcagcauuguagaua

SEQ ID NO: 8516 - RNA, 19 nt, Artificial Sequence
  Description of Artificial Sequence: Synthetic oligonucleotide
uaucuacaaugcugcaccu

SEQ ID NO: 8517 - RNA, 19 nt, Artificial Sequence
  Description of Artificial Sequence: Synthetic oligonucleotide
ggugcagcauuguagauaa

SEQ ID NO: 8518 - RNA, 19 nt, Artificial Sequence
  Description of Artificial Sequence: Synthetic oligonucleotide
uuaucuacaaugcugcacc

SEQ ID NO: 8519 - RNA, 19 nt, Artificial Sequence
  Description of Artificial Sequence: Synthetic oligonucleotide
gugcagcauuguagauaag

SEQ ID NO: 8520 - RNA, 19 nt, Artificial Sequence
  Description of Artificial Sequence: Synthetic oligonucleotide
cuuaucuacaaugcugcac

SEQ ID NO: 8521 - RNA, 19 nt, Artificial Sequence
  Description of Artificial Sequence: Synthetic oligonucleotide
ugcagcauuguagauaaga

SEQ ID NO: 8522 - RNA, 19 nt, Artificial Sequence
  Description of Artificial Sequence: Synthetic oligonucleotide
ucuuaucuacaaugcugca

SEQ ID NO: 8523 - RNA, 19 nt, Artificial Sequence
  Description of Artificial Sequence: Synthetic oligonucleotide
gcauuguagauaagacaga

SEQ ID NO: 8524 - RNA, 19 nt, Artificial Sequence
  Description of Artificial Sequence: Synthetic oligonucleotide
ucugucuuaucuacaaugc

SEQ ID NO: 8525 - RNA, 19 nt, Artificial Sequence
  Description of Artificial Sequence: Synthetic oligonucleotide
cauuguagauaagacagaa

SEQ ID NO: 8526 - RNA, 19 nt, Artificial Sequence
  Description of Artificial Sequence: Synthetic oligonucleotide
uucugucuuaucuacaaug

SEQ ID NO: 8527 - RNA, 19 nt, Artificial Sequence
  Description of Artificial Sequence: Synthetic oligonucleotide
auuguagauaagacagaag

SEQ ID NO: 8528 - RNA, 19 nt, Artificial Sequence
  Description of Artificial Sequence: Synthetic oligonucleotide
cuucugucuuaucuacaau

SEQ ID NO: 8529 - RNA, 19 nt, Artificial Sequence
  Description of Artificial Sequence: Synthetic oligonucleotide
auaagacagaaggguggac

SEQ ID NO: 8530 - RNA, 19 nt, Artificial Sequence
  Description of Artificial Sequence: Synthetic oligonucleotide
guccacccuucugucuuau

SEQ ID NO: 8531 - RNA, 19 nt, Artificial Sequence
  Description of Artificial Sequence: Synthetic oligonucleotide
uaagacagaaggguggacu

SEQ ID NO: 8532 - RNA, 19 nt, Artificial Sequence
  Description of Artificial Sequence: Synthetic oligonucleotide
aguccacccuucugucuua

SEQ ID NO: 8533 - RNA, 19 nt, Artificial Sequence
  Description of Artificial Sequence: Synthetic oligonucleotide
aaccuggcuugcuuuccaa

SEQ ID NO: 8534 - RNA, 19 nt, Artificial Sequence
  Description of Artificial Sequence: Synthetic oligonucleotide
uuggaaagcaagccagguu

SEQ ID NO: 8535 - RNA, 19 nt, Artificial Sequence
  Description of Artificial Sequence: Synthetic oligonucleotide
ccuggcuugcuuuccaauu

SEQ ID NO: 8536 - RNA, 19 nt, Artificial Sequence
  Description of Artificial Sequence: Synthetic oligonucleotide
aauuggaaagcaagccagg

SEQ ID NO: 8537 - RNA, 19 nt, Artificial Sequence
  Description of Artificial Sequence: Synthetic oligonucleotide
accagaagugacuuggagg

SEQ ID NO: 8538 - RNA, 19 nt, Artificial Sequence
  Description of Artificial Sequence: Synthetic oligonucleotide
ccuccaagucacuucuggu

SEQ ID NO: 8539 - RNA, 19 nt, Artificial Sequence
  Description of Artificial Sequence: Synthetic oligonucleotide
ccagaagugacuuggaggg

SEQ ID NO: 8540 - RNA, 19 nt, Artificial Sequence
  Description of Artificial Sequence: Synthetic oligonucleotide
cccuccaagucacuucugg

SEQ ID NO: 8541 - RNA, 19 nt, Artificial Sequence
  Description of Artificial Sequence: Synthetic oligonucleotide
agaugccaaugacauggua

SEQ ID NO: 8542 - RNA, 19 nt, Artificial Sequence
  Description of Artificial Sequence: Synthetic oligonucleotide
uaccaugucauuggcaucu

SEQ ID NO: 8543 - RNA, 19 nt, Artificial Sequence
  Description of Artificial Sequence: Synthetic oligonucleotide
gaugccaaugacaugguag

SEQ ID NO: 8544 - RNA, 19 nt, Artificial Sequence
  Description of Artificial Sequence: Synthetic oligonucleotide
cuaccaugucauuggcauc

SEQ ID NO: 8545 - RNA, 19 nt, Artificial Sequence
  Description of Artificial Sequence: Synthetic oligonucleotide
augccaaugacaugguagg

SEQ ID NO: 8546 - RNA, 19 nt, Artificial Sequence
  Description of Artificial Sequence: Synthetic oligonucleotide
ccuaccaugucauuggcau

SEQ ID NO: 8547 - RNA, 19 nt, Artificial Sequence
  Description of Artificial Sequence: Synthetic oligonucleotide
caaugacaugguaggagca

SEQ ID NO: 8548 - RNA, 19 nt, Artificial Sequence
  Description of Artificial Sequence: Synthetic oligonucleotide
ugcuccuaccaugucauug

SEQ ID NO: 8549 - RNA, 19 nt, Artificial Sequence
  Description of Artificial Sequence: Synthetic oligonucleotide
aaugacaugguaggagcaa

SEQ ID NO: 8550 - RNA, 19 nt, Artificial Sequence
  Description of Artificial Sequence: Synthetic oligonucleotide
uugcuccuaccaugucauu

SEQ ID NO: 8551 - RNA, 19 nt, Artificial Sequence
  Description of Artificial Sequence: Synthetic oligonucleotide
augacaugguaggagcaaa

SEQ ID NO: 8552 - RNA, 19 nt, Artificial Sequence
  Description of Artificial Sequence: Synthetic oligonucleotide
uuugcuccuaccaugucau

SEQ ID NO: 8553 - RNA, 19 nt, Artificial Sequence
  Description of Artificial Sequence: Synthetic oligonucleotide
ugacaugguaggagcaaag

SEQ ID NO: 8554 - RNA, 19 nt, Artificial Sequence
  Description of Artificial Sequence: Synthetic oligonucleotide
cuuugcuccuaccauguca

SEQ ID NO: 8555 - RNA, 19 nt, Artificial Sequence
  Description of Artificial Sequence: Synthetic oligonucleotide
gacaugguaggagcaaaga

SEQ ID NO: 8556 - RNA, 19 nt, Artificial Sequence
  Description of Artificial Sequence: Synthetic oligonucleotide
ucuuugcuccuaccauguc

SEQ ID NO: 8557 - RNA, 19 nt, Artificial Sequence
  Description of Artificial Sequence: Synthetic oligonucleotide
aaaaggucagccucuagcu

SEQ ID NO: 8558 - RNA, 19 nt, Artificial Sequence
  Description of Artificial Sequence: Synthetic oligonucleotide
agcuagaggcugaccuuuu

SEQ ID NO: 8559 - RNA, 19 nt, Artificial Sequence
  Description of Artificial Sequence: Synthetic oligonucleotide
aaaggucagccucuagcua

SEQ ID NO: 8560 - RNA, 19 nt, Artificial Sequence
  Description of Artificial Sequence: Synthetic oligonucleotide
uagcuagaggcugaccuuu

SEQ ID NO: 8561 - RNA, 19 nt, Artificial Sequence
  Description of Artificial Sequence: Synthetic oligonucleotide
aggucagccucuagcuagg

SEQ ID NO: 8562 - RNA, 19 nt, Artificial Sequence
  Description of Artificial Sequence: Synthetic oligonucleotide
ccuagcuagaggcugaccu

SEQ ID NO: 8563 - RNA, 19 nt, Artificial Sequence
  Description of Artificial Sequence: Synthetic oligonucleotide
ggucagccucuagcuagga

SEQ ID NO: 8564 - RNA, 19 nt, Artificial Sequence
  Description of Artificial Sequence: Synthetic oligonucleotide
uccuagcuagaggcugacc

SEQ ID NO: 8565 - RNA, 19 nt, Artificial Sequence
  Description of Artificial Sequence: Synthetic oligonucleotide
gucagccucuagcuaggau

SEQ ID NO: 8566 - RNA, 19 nt, Artificial Sequence
  Description of Artificial Sequence: Synthetic oligonucleotide
auccuagcuagaggcugac

SEQ ID NO: 8567 - RNA, 19 nt, Artificial Sequence
  Description of Artificial Sequence: Synthetic oligonucleotide
cagccucuagcuaggaucc

SEQ ID NO: 8568 - RNA, 19 nt, Artificial Sequence
  Description of Artificial Sequence: Synthetic oligonucleotide
ggauccuagcuagaggcug

SEQ ID NO: 8569 - RNA, 19 nt, Artificial Sequence
  Description of Artificial Sequence: Synthetic oligonucleotide
agccucuagcuaggauccc

SEQ ID NO: 8570 - RNA, 19 nt, Artificial Sequence
  Description of Artificial Sequence: Synthetic oligonucleotide
gggauccuagcuagaggcu

SEQ ID NO: 8571 - RNA, 19 nt, Artificial Sequence
  Description of Artificial Sequence: Synthetic oligonucleotide
agagcugcaaccuuuagga

SEQ ID NO: 8572 - RNA, 19 nt, Artificial Sequence
  Description of Artificial Sequence: Synthetic oligonucleotide
uccuaaagguugcagcucu

SEQ ID NO: 8573 - RNA, 19 nt, Artificial Sequence
  Description of Artificial Sequence: Synthetic oligonucleotide
gagcugcaaccuuuaggag

SEQ ID NO: 8574 - RNA, 19 nt, Artificial Sequence
  Description of Artificial Sequence: Synthetic oligonucleotide
cuccuaaagguugcagcuc

SEQ ID NO: 8575 - RNA, 19 nt, Artificial Sequence
  Description of Artificial Sequence: Synthetic oligonucleotide
agcugcaaccuuuaggagg

SEQ ID NO: 8576 - RNA, 19 nt, Artificial Sequence
  Description of Artificial Sequence: Synthetic oligonucleotide
ccuccuaaagguugcagcu

SEQ ID NO: 8577 - RNA, 19 nt, Artificial Sequence
  Description of Artificial Sequence: Synthetic oligonucleotide
uuuaggagguaucaaagug

SEQ ID NO: 8578 - RNA, 19 nt, Artificial Sequence
  Description of Artificial Sequence: Synthetic oligonucleotide
cacuuugauaccuccuaaa

SEQ ID NO: 8579 - RNA, 19 nt, Artificial Sequence
  Description of Artificial Sequence: Synthetic oligonucleotide
uuaggagguaucaaagugc

SEQ ID NO: 8580 - RNA, 19 nt, Artificial Sequence
  Description of Artificial Sequence: Synthetic oligonucleotide
gcacuuugauaccuccuaa

SEQ ID NO: 8581 - RNA, 19 nt, Artificial Sequence
  Description of Artificial Sequence: Synthetic oligonucleotide
uaggagguaucaaagugcc

SEQ ID NO: 8582 - RNA, 19 nt, Artificial Sequence
  Description of Artificial Sequence: Synthetic oligonucleotide
ggcacuuugauaccuccua

SEQ ID NO: 8583 - RNA, 19 nt, Artificial Sequence
  Description of Artificial Sequence: Synthetic oligonucleotide
gucaaagugggacaucgac

SEQ ID NO: 8584 - RNA, 19 nt, Artificial Sequence
  Description of Artificial Sequence: Synthetic oligonucleotide
gucgaugucccacuuugac

SEQ ID NO: 8585 - RNA, 19 nt, Artificial Sequence
  Description of Artificial Sequence: Synthetic oligonucleotide
caucgaccaaugucuagag

SEQ ID NO: 8586 - RNA, 19 nt, Artificial Sequence
  Description of Artificial Sequence: Synthetic oligonucleotide
cucuagacauuggucgaug

SEQ ID NO: 8587 - RNA, 19 nt, Artificial Sequence
  Description of Artificial Sequence: Synthetic oligonucleotide
aucgaccaaugucuagagc

SEQ ID NO: 8588 - RNA, 19 nt, Artificial Sequence
  Description of Artificial Sequence: Synthetic oligonucleotide
gcucuagacauuggucgau

SEQ ID NO: 8589 - RNA, 19 nt, Artificial Sequence
  Description of Artificial Sequence: Synthetic oligonucleotide
accaaugucuagagccaac

SEQ ID NO: 8590 - RNA, 19 nt, Artificial Sequence
  Description of Artificial Sequence: Synthetic oligonucleotide
guuggcucuagacauuggu

SEQ ID NO: 8591 - RNA, 19 nt, Artificial Sequence
  Description of Artificial Sequence: Synthetic oligonucleotide
caaugucuagagccaacug

SEQ ID NO: 8592 - RNA, 19 nt, Artificial Sequence
  Description of Artificial Sequence: Synthetic oligonucleotide
caguuggcucuagacauug

SEQ ID NO: 8593 - RNA, 19 nt, Artificial Sequence
  Description of Artificial Sequence: Synthetic oligonucleotide
aaugucuagagccaacuga

SEQ ID NO: 8594 - RNA, 19 nt, Artificial Sequence
  Description of Artificial Sequence: Synthetic oligonucleotide
ucaguuggcucuagacauu

SEQ ID NO: 8595 - RNA, 19 nt, Artificial Sequence
  Description of Artificial Sequence: Synthetic oligonucleotide
augucuagagccaacugau

SEQ ID NO: 8596 - RNA, 19 nt, Artificial Sequence
  Description of Artificial Sequence: Synthetic oligonucleotide
aucaguuggcucuagacau

SEQ ID NO: 8597 - RNA, 19 nt, Artificial Sequence
  Description of Artificial Sequence: Synthetic oligonucleotide
ugucuagagccaacugaug

SEQ ID NO: 8598 - RNA, 19 nt, Artificial Sequence
  Description of Artificial Sequence: Synthetic oligonucleotide
caucaguuggcucuagaca

SEQ ID NO: 8599 - RNA, 19 nt, Artificial Sequence
  Description of Artificial Sequence: Synthetic oligonucleotide
gucuagagccaacugaugg

SEQ ID NO: 8600 - RNA, 19 nt, Artificial Sequence
  Description of Artificial Sequence: Synthetic oligonucleotide
ccaucaguuggcucuagac

SEQ ID NO: 8601 - RNA, 19 nt, Artificial Sequence
  Description of Artificial Sequence: Synthetic oligonucleotide
ucuagagccaacugaugga

SEQ ID NO: 8602 - RNA, 19 nt, Artificial Sequence
  Description of Artificial Sequence: Synthetic oligonucleotide
uccaucaguuggcucuaga

SEQ ID NO: 8603 - RNA, 19 nt, Artificial Sequence
  Description of Artificial Sequence: Synthetic oligonucleotide
cuagagccaacugauggau

SEQ ID NO: 8604 - RNA, 19 nt, Artificial Sequence
  Description of Artificial Sequence: Synthetic oligonucleotide
auccaucaguuggcucuag

SEQ ID NO: 8605 - RNA, 19 nt, Artificial Sequence
  Description of Artificial Sequence: Synthetic oligonucleotide
uagagccaacugauggaug

SEQ ID NO: 8606 - RNA, 19 nt, Artificial Sequence
  Description of Artificial Sequence: Synthetic oligonucleotide
cauccaucaguuggcucua

SEQ ID NO: 8607 - RNA, 19 nt, Artificial Sequence
  Description of Artificial Sequence: Synthetic oligonucleotide
agagccaacugauggaugu

SEQ ID NO: 8608 - RNA, 19 nt, Artificial Sequence
  Description of Artificial Sequence: Synthetic oligonucleotide
acauccaucaguuggcucu

SEQ ID NO: 8609 - RNA, 19 nt, Artificial Sequence
  Description of Artificial Sequence: Synthetic oligonucleotide
gagccaacugauggauguu

SEQ ID NO: 8610 - RNA, 19 nt, Artificial Sequence
  Description of Artificial Sequence: Synthetic oligonucleotide
aacauccaucaguuggcuc

SEQ ID NO: 8611 - RNA, 19 nt, Artificial Sequence
  Description of Artificial Sequence: Synthetic oligonucleotide
aacugauggauguugggca

SEQ ID NO: 8612 - RNA, 19 nt, Artificial Sequence
  Description of Artificial Sequence: Synthetic oligonucleotide
ugcccaacauccaucaguu

SEQ ID NO: 8613 - RNA, 19 nt, Artificial Sequence
  Description of Artificial Sequence: Synthetic oligonucleotide
uggauguugggcagcuaaa

SEQ ID NO: 8614 - RNA, 19 nt, Artificial Sequence
  Description of Artificial Sequence: Synthetic oligonucleotide
uuuagcugcccaacaucca

SEQ ID NO: 8615 - RNA, 19 nt, Artificial Sequence
  Description of Artificial Sequence: Synthetic oligonucleotide
ggauguugggcagcuaaag

SEQ ID NO: 8616 - RNA, 19 nt, Artificial Sequence
  Description of Artificial Sequence: Synthetic oligonucleotide
cuuuagcugcccaacaucc

SEQ ID NO: 8617 - RNA, 19 nt, Artificial Sequence
  Description of Artificial Sequence: Synthetic oligonucleotide
gauguugggcagcuaaaga

SEQ ID NO: 8618 - RNA, 19 nt, Artificial Sequence
  Description of Artificial Sequence: Synthetic oligonucleotide
ucuuuagcugcccaacauc

SEQ ID NO: 8619 - RNA, 19 nt, Artificial Sequence
  Description of Artificial Sequence: Synthetic oligonucleotide
uugggcagcuaaagaggga

SEQ ID NO: 8620 - RNA, 19 nt, Artificial Sequence
  Description of Artificial Sequence: Synthetic oligonucleotide
ucccucuuuagcugcccaa

SEQ ID NO: 8621 - RNA, 19 nt, Artificial Sequence
  Description of Artificial Sequence: Synthetic oligonucleotide
ugggcagcuaaagagggaa

SEQ ID NO: 8622 - RNA, 19 nt, Artificial Sequence
  Description of Artificial Sequence: Synthetic oligonucleotide
uucccucuuuagcugccca

SEQ ID NO: 8623 - RNA, 19 nt, Artificial Sequence
  Description of Artificial Sequence: Synthetic oligonucleotide
gggcagcuaaagagggaag

SEQ ID NO: 8624 - RNA, 19 nt, Artificial Sequence
  Description of Artificial Sequence: Synthetic oligonucleotide
cuucccucuuuagcugccc

SEQ ID NO: 8625 - RNA, 19 nt, Artificial Sequence
  Description of Artificial Sequence: Synthetic oligonucleotide
ggcagcuaaagagggaagg

SEQ ID NO: 8626 - RNA, 19 nt, Artificial Sequence
  Description of Artificial Sequence: Synthetic oligonucleotide
ccuucccucuuuagcugcc

SEQ ID NO: 8627 - RNA, 19 nt, Artificial Sequence
  Description of Artificial Sequence: Synthetic oligonucleotide
gcagcuaaagagggaaggg

SEQ ID NO: 8628 - RNA, 19 nt, Artificial Sequence
  Description of Artificial Sequence: Synthetic oligonucleotide
cccuucccucuuuagcugc

SEQ ID NO: 8629 - RNA, 19 nt, Artificial Sequence
  Description of Artificial Sequence: Synthetic oligonucleotide
gggcaugggauaagaccug

SEQ ID NO: 8630 - RNA, 19 nt, Artificial Sequence
  Description of Artificial Sequence: Synthetic oligonucleotide
caggucuuaucccaugccc

SEQ ID NO: 8631 - RNA, 19 nt, Artificial Sequence
  Description of Artificial Sequence: Synthetic oligonucleotide
ggcaugggauaagaccugc

SEQ ID NO: 8632 - RNA, 19 nt, Artificial Sequence
  Description of Artificial Sequence: Synthetic oligonucleotide
gcaggucuuaucccaugcc

SEQ ID NO: 8633 - RNA, 19 nt, Artificial Sequence
  Description of Artificial Sequence: Synthetic oligonucleotide
gcaugggauaagaccugcc

SEQ ID NO: 8634 - RNA, 19 nt, Artificial Sequence
  Description of Artificial Sequence: Synthetic oligonucleotide
ggcaggucuuaucccaugc

SEQ ID NO: 8635 - RNA, 19 nt, Artificial Sequence
  Description of Artificial Sequence: Synthetic oligonucleotide
caugggauaagaccugccc

SEQ ID NO: 8636 - RNA, 19 nt, Artificial Sequence
  Description of Artificial Sequence: Synthetic oligonucleotide
gggcaggucuuaucccaug

SEQ ID NO: 8637 - RNA, 19 nt, Artificial Sequence
  Description of Artificial Sequence: Synthetic oligonucleotide
augggauaagaccugcccu

SEQ ID NO: 8638 - RNA, 19 nt, Artificial Sequence
  Description of Artificial Sequence: Synthetic oligonucleotide
agggcaggucuuaucccau

SEQ ID NO: 8639 - RNA, 19 nt, Artificial Sequence
  Description of Artificial Sequence: Synthetic oligonucleotide
ugggauaagaccugcccuu

SEQ ID NO: 8640 - RNA, 19 nt, Artificial Sequence
  Description of Artificial Sequence: Synthetic oligonucleotide
aagggcaggucuuauccca

SEQ ID NO: 8641 - RNA, 19 nt, Artificial Sequence
  Description of Artificial Sequence: Synthetic oligonucleotide
gggauaagaccugcccuuc

SEQ ID NO: 8642 - RNA, 19 nt, Artificial Sequence
  Description of Artificial Sequence: Synthetic oligonucleotide
gaagggcaggucuuauccc

SEQ ID NO: 8643 - RNA, 19 nt, Artificial Sequence
  Description of Artificial Sequence: Synthetic oligonucleotide
ggauaagaccugcccuucu

SEQ ID NO: 8644 - RNA, 19 nt, Artificial Sequence
  Description of Artificial Sequence: Synthetic oligonucleotide
agaagggcaggucuuaucc

SEQ ID NO: 8645 - RNA, 19 nt, Artificial Sequence
  Description of Artificial Sequence: Synthetic oligonucleotide
agaccugcccuucuugcuu

SEQ ID NO: 8646 - RNA, 19 nt, Artificial Sequence
  Description of Artificial Sequence: Synthetic oligonucleotide
aagcaagaagggcaggucu

SEQ ID NO: 8647 - RNA, 19 nt, Artificial Sequence
  Description of Artificial Sequence: Synthetic oligonucleotide
gaccugcccuucuugcuuc

SEQ ID NO: 8648 - RNA, 19 nt, Artificial Sequence
  Description of Artificial Sequence: Synthetic oligonucleotide
gaagcaagaagggcagguc

SEQ ID NO: 8649 - RNA, 19 nt, Artificial Sequence
  Description of Artificial Sequence: Synthetic oligonucleotide
ccugcccuucuugcuucuu

SEQ ID NO: 8650 - RNA, 19 nt, Artificial Sequence
  Description of Artificial Sequence: Synthetic oligonucleotide
aagaagcaagaagggcagg

SEQ ID NO: 8651 - RNA, 19 nt, Artificial Sequence
  Description of Artificial Sequence: Synthetic oligonucleotide
cugcccuucuugcuucuug

SEQ ID NO: 8652 - RNA, 19 nt, Artificial Sequence
  Description of Artificial Sequence: Synthetic oligonucleotide
caagaagcaagaagggcag

SEQ ID NO: 8653 - RNA, 19 nt, Artificial Sequence
  Description of Artificial Sequence: Synthetic oligonucleotide
ugcccuucuugcuucuugc

SEQ ID NO: 8654 - RNA, 19 nt, Artificial Sequence
  Description of Artificial Sequence: Synthetic oligonucleotide
gcaagaagcaagaagggca

SEQ ID NO: 8655 - RNA, 19 nt, Artificial Sequence
  Description of Artificial Sequence: Synthetic oligonucleotide
ucuugcuucuugccauugg

SEQ ID NO: 8656 - RNA, 19 nt, Artificial Sequence
  Description of Artificial Sequence: Synthetic oligonucleotide
ccaauggcaagaagcaaga

SEQ ID NO: 8657 - RNA, 19 nt, Artificial Sequence
  Description of Artificial Sequence: Synthetic oligonucleotide
cuugcuucuugccauuggg

SEQ ID NO: 8658 - RNA, 19 nt, Artificial Sequence
  Description of Artificial Sequence: Synthetic oligonucleotide
cccaauggcaagaagcaag

SEQ ID NO: 8659 - RNA, 19 nt, Artificial Sequence
  Description of Artificial Sequence: Synthetic oligonucleotide
uugcuucuugccauugggc

SEQ ID NO: 8660 - RNA, 19 nt, Artificial Sequence
  Description of Artificial Sequence: Synthetic oligonucleotide
gcccaauggcaagaagcaa

SEQ ID NO: 8661 - RNA, 19 nt, Artificial Sequence
  Description of Artificial Sequence: Synthetic oligonucleotide
ccauugggcaggcauugga

SEQ ID NO: 8662 - RNA, 19 nt, Artificial Sequence
  Description of Artificial Sequence: Synthetic oligonucleotide
uccaaugccugcccaaugg

SEQ ID NO: 8663 - RNA, 19 nt, Artificial Sequence
  Description of Artificial Sequence: Synthetic oligonucleotide
cauugggcaggcauuggag

SEQ ID NO: 8664 - RNA, 19 nt, Artificial Sequence
  Description of Artificial Sequence: Synthetic oligonucleotide
cuccaaugccugcccaaug

SEQ ID NO: 8665 - RNA, 19 nt, Artificial Sequence
  Description of Artificial Sequence: Synthetic oligonucleotide
gacccuacugcugaaugga

SEQ ID NO: 8666 - RNA, 19 nt, Artificial Sequence
  Description of Artificial Sequence: Synthetic oligonucleotide
uccauucagcaguaggguc

SEQ ID NO: 8667 - RNA, 19 nt, Artificial Sequence
  Description of Artificial Sequence: Synthetic oligonucleotide
uacugcugaauggagugcu

SEQ ID NO: 8668 - RNA, 19 nt, Artificial Sequence
  Description of Artificial Sequence: Synthetic oligonucleotide
agcacuccauucagcagua

SEQ ID NO: 8669 - RNA, 19 nt, Artificial Sequence
  Description of Artificial Sequence: Synthetic oligonucleotide
acugcugaauggagugcua

SEQ ID NO: 8670 - RNA, 19 nt, Artificial Sequence
  Description of Artificial Sequence: Synthetic oligonucleotide
uagcacuccauucagcagu

SEQ ID NO: 8671 - RNA, 19 nt, Artificial Sequence
  Description of Artificial Sequence: Synthetic oligonucleotide
cugcugaauggagugcuaa

SEQ ID NO: 8672 - RNA, 19 nt, Artificial Sequence
  Description of Artificial Sequence: Synthetic oligonucleotide
uuagcacuccauucagcag

SEQ ID NO: 8673 - RNA, 19 nt, Artificial Sequence
  Description of Artificial Sequence: Synthetic oligonucleotide
ugcugaauggagugcuaac

SEQ ID NO: 8674 - RNA, 19 nt, Artificial Sequence
  Description of Artificial Sequence: Synthetic oligonucleotide
guuagcacuccauucagca

SEQ ID NO: 8675 - RNA, 19 nt, Artificial Sequence
  Description of Artificial Sequence: Synthetic oligonucleotide
gcugaauggagugcuaacc

SEQ ID NO: 8676 - RNA, 19 nt, Artificial Sequence
  Description of Artificial Sequence: Synthetic oligonucleotide
gguuagcacuccauucagc

SEQ ID NO: 8677 - RNA, 19 nt, Artificial Sequence
  Description of Artificial Sequence: Synthetic oligonucleotide
cugaauggagugcuaaccc

SEQ ID NO: 8678 - RNA, 19 nt, Artificial Sequence
  Description of Artificial Sequence: Synthetic oligonucleotide
ggguuagcacuccauucag

SEQ ID NO: 8679 - RNA, 19 nt, Artificial Sequence
  Description of Artificial Sequence: Synthetic oligonucleotide
uaacccuggugcuagagga

SEQ ID NO: 8680 - RNA, 19 nt, Artificial Sequence
  Description of Artificial Sequence: Synthetic oligonucleotide
uccucuagcaccaggguua

SEQ ID NO: 8681 - RNA, 19 nt, Artificial Sequence
  Description of Artificial Sequence: Synthetic oligonucleotide
aacccuggugcuagaggag

SEQ ID NO: 8682 - RNA, 19 nt, Artificial Sequence
  Description of Artificial Sequence: Synthetic oligonucleotide
cuccucuagcaccaggguu

SEQ ID NO: 8683 - RNA, 19 nt, Artificial Sequence
  Description of Artificial Sequence: Synthetic oligonucleotide
acccuggugcuagaggagg

SEQ ID NO: 8684 - RNA, 19 nt, Artificial Sequence
  Description of Artificial Sequence: Synthetic oligonucleotide
ccuccucuagcaccagggu

SEQ ID NO: 8685 - RNA, 19 nt, Artificial Sequence
  Description of Artificial Sequence: Synthetic oligonucleotide
cccuggugcuagaggagga

SEQ ID NO: 8686 - RNA, 19 nt, Artificial Sequence
  Description of Artificial Sequence: Synthetic oligonucleotide
uccuccucuagcaccaggg

SEQ ID NO: 8687 - RNA, 19 nt, Artificial Sequence
  Description of Artificial Sequence: Synthetic oligonucleotide
ccuggugcuagaggaggau

SEQ ID NO: 8688 - RNA, 19 nt, Artificial Sequence
  Description of Artificial Sequence: Synthetic oligonucleotide
auccuccucuagcaccagg

SEQ ID NO: 8689 - RNA, 19 nt, Artificial Sequence
  Description of Artificial Sequence: Synthetic oligonucleotide
cuggugcuagaggaggaug

SEQ ID NO: 8690 - RNA, 19 nt, Artificial Sequence
  Description of Artificial Sequence: Synthetic oligonucleotide
cauccuccucuagcaccag

SEQ ID NO: 8691 - RNA, 19 nt, Artificial Sequence
  Description of Artificial Sequence: Synthetic oligonucleotide
ggugcuagaggaggaugga

SEQ ID NO: 8692 - RNA, 19 nt, Artificial Sequence
  Description of Artificial Sequence: Synthetic oligonucleotide
uccauccuccucuagcacc

SEQ ID NO: 8693 - RNA, 19 nt, Artificial Sequence
  Description of Artificial Sequence: Synthetic oligonucleotide
gugcuagaggaggauggaa

SEQ ID NO: 8694 - RNA, 19 nt, Artificial Sequence
  Description of Artificial Sequence: Synthetic oligonucleotide
uuccauccuccucuagcac

SEQ ID NO: 8695 - RNA, 19 nt, Artificial Sequence
  Description of Artificial Sequence: Synthetic oligonucleotide
cugcaguggacagugagga

SEQ ID NO: 8696 - RNA, 19 nt, Artificial Sequence
  Description of Artificial Sequence: Synthetic oligonucleotide
uccucacuguccacugcag

SEQ ID NO: 8697 - RNA, 19 nt, Artificial Sequence
  Description of Artificial Sequence: Synthetic oligonucleotide
ugcaguggacagugaggac

SEQ ID NO: 8698 - RNA, 19 nt, Artificial Sequence
  Description of Artificial Sequence: Synthetic oligonucleotide
guccucacuguccacugca

SEQ ID NO: 8699 - RNA, 19 nt, Artificial Sequence
  Description of Artificial Sequence: Synthetic oligonucleotide
gcaguggacagugaggacu

SEQ ID NO: 8700 - RNA, 19 nt, Artificial Sequence
  Description of Artificial Sequence: Synthetic oligonucleotide
aguccucacuguccacugc

SEQ ID NO: 8701 - RNA, 19 nt, Artificial Sequence
  Description of Artificial Sequence: Synthetic oligonucleotide
caguggacagugaggacuu

SEQ ID NO: 8702 - RNA, 19 nt, Artificial Sequence
  Description of Artificial Sequence: Synthetic oligonucleotide
aaguccucacuguccacug

SEQ ID NO: 8703 - RNA, 19 nt, Artificial Sequence
  Description of Artificial Sequence: Synthetic oligonucleotide
aguggacagugaggacuuc

SEQ ID NO: 8704 - RNA, 19 nt, Artificial Sequence
  Description of Artificial Sequence: Synthetic oligonucleotide
gaaguccucacuguccacu

SEQ ID NO: 8705 - RNA, 19 nt, Artificial Sequence
  Description of Artificial Sequence: Synthetic oligonucleotide
guggacagugaggacuucu

SEQ ID NO: 8706 - RNA, 19 nt, Artificial Sequence
  Description of Artificial Sequence: Synthetic oligonucleotide
agaaguccucacuguccac

SEQ ID NO: 8707 - RNA, 19 nt, Artificial Sequence
  Description of Artificial Sequence: Synthetic oligonucleotide
uggacagugaggacuucuu

SEQ ID NO: 8708 - RNA, 19 nt, Artificial Sequence
  Description of Artificial Sequence: Synthetic oligonucleotide
aagaaguccucacugucca

SEQ ID NO: 8709 - RNA, 19 nt, Artificial Sequence
  Description of Artificial Sequence: Synthetic oligonucleotide
ggacagugaggacuucuuc

SEQ ID NO: 8710 - RNA, 19 nt, Artificial Sequence
  Description of Artificial Sequence: Synthetic oligonucleotide
gaagaaguccucacugucc

SEQ ID NO: 8711 - RNA, 19 nt, Artificial Sequence
  Description of Artificial Sequence: Synthetic oligonucleotide
agugaggacuucuuccagc

SEQ ID NO: 8712 - RNA, 19 nt, Artificial Sequence
  Description of Artificial Sequence: Synthetic oligonucleotide
gcuggaagaaguccucacu

SEQ ID NO: 8713 - RNA, 19 nt, Artificial Sequence
  Description of Artificial Sequence: Synthetic oligonucleotide
gugaggacuucuuccagcu

SEQ ID NO: 8714 - RNA, 19 nt, Artificial Sequence
  Description of Artificial Sequence: Synthetic oligonucleotide
agcuggaagaaguccucac

SEQ ID NO: 8715 - RNA, 19 nt, Artificial Sequence
  Description of Artificial Sequence: Synthetic oligonucleotide
ugaggacuucuuccagcug

SEQ ID NO: 8716 - RNA, 19 nt, Artificial Sequence
  Description of Artificial Sequence: Synthetic oligonucleotide
cagcuggaagaaguccuca

SEQ ID NO: 8717 - RNA, 19 nt, Artificial Sequence
  Description of Artificial Sequence: Synthetic oligonucleotide
gaggacuucuuccagcugc

SEQ ID NO: 8718 - RNA, 19 nt, Artificial Sequence
  Description of Artificial Sequence: Synthetic oligonucleotide
gcagcuggaagaaguccuc

SEQ ID NO: 8719 - RNA, 19 nt, Artificial Sequence
  Description of Artificial Sequence: Synthetic oligonucleotide
gugccugaugguguugcag

SEQ ID NO: 8720 - RNA, 19 nt, Artificial Sequence
  Description of Artificial Sequence: Synthetic oligonucleotide
cugcaacaccaucaggcac

SEQ ID NO: 8721 - RNA, 19 nt, Artificial Sequence
  Description of Artificial Sequence: Synthetic oligonucleotide
gaugguguugcagucuggu

SEQ ID NO: 8722 - RNA, 19 nt, Artificial Sequence
  Description of Artificial Sequence: Synthetic oligonucleotide
accagacugcaacaccauc

SEQ ID NO: 8723 - RNA, 19 nt, Artificial Sequence
  Description of Artificial Sequence: Synthetic oligonucleotide
ugguguugcagucugguca

SEQ ID NO: 8724 - RNA, 19 nt, Artificial Sequence
  Description of Artificial Sequence: Synthetic oligonucleotide
ugaccagacugcaacacca

SEQ ID NO: 8725 - RNA, 19 nt, Artificial Sequence
  Description of Artificial Sequence: Synthetic oligonucleotide
gguguugcagucuggucag

SEQ ID NO: 8726 - RNA, 19 nt, Artificial Sequence
  Description of Artificial Sequence: Synthetic oligonucleotide
cugaccagacugcaacacc

SEQ ID NO: 8727 - RNA, 19 nt, Artificial Sequence
  Description of Artificial Sequence: Synthetic oligonucleotide
guguugcagucuggucaga

SEQ ID NO: 8728 - RNA, 19 nt, Artificial Sequence
  Description of Artificial Sequence: Synthetic oligonucleotide
ucugaccagacugcaacac

SEQ ID NO: 8729 - RNA, 19 nt, Artificial Sequence
  Description of Artificial Sequence: Synthetic oligonucleotide
ugcagucuggucagagcug

SEQ ID NO: 8730 - RNA, 19 nt, Artificial Sequence
  Description of Artificial Sequence: Synthetic oligonucleotide
cagcucugaccagacugca

SEQ ID NO: 8731 - RNA, 19 nt, Artificial Sequence
  Description of Artificial Sequence: Synthetic oligonucleotide
gcagucuggucagagcugg

SEQ ID NO: 8732 - RNA, 19 nt, Artificial Sequence
  Description of Artificial Sequence: Synthetic oligonucleotide
ccagcucugaccagacugc

SEQ ID NO: 8733 - RNA, 19 nt, Artificial Sequence
  Description of Artificial Sequence: Synthetic oligonucleotide
cagucuggucagagcugga

SEQ ID NO: 8734 - RNA, 19 nt, Artificial Sequence
  Description of Artificial Sequence: Synthetic oligonucleotide
uccagcucugaccagacug

SEQ ID NO: 8735 - RNA, 19 nt, Artificial Sequence
  Description of Artificial Sequence: Synthetic oligonucleotide
agucuggucagagcuggag

SEQ ID NO: 8736 - RNA, 19 nt, Artificial Sequence
  Description of Artificial Sequence: Synthetic oligonucleotide
cuccagcucugaccagacu

SEQ ID NO: 8737 - RNA, 19 nt, Artificial Sequence
  Description of Artificial Sequence: Synthetic oligonucleotide
gucuggucagagcuggagc

SEQ ID NO: 8738 - RNA, 19 nt, Artificial Sequence
  Description of Artificial Sequence: Synthetic oligonucleotide
gcuccagcucugaccagac

SEQ ID NO: 8739 - RNA, 19 nt, Artificial Sequence
  Description of Artificial Sequence: Synthetic oligonucleotide
ucuggucagagcuggagcc

SEQ ID NO: 8740 - RNA, 19 nt, Artificial Sequence
  Description of Artificial Sequence: Synthetic oligonucleotide
ggcuccagcucugaccaga

SEQ ID NO: 8741 - RNA, 19 nt, Artificial Sequence
  Description of Artificial Sequence: Synthetic oligonucleotide
uggucagagcuggagcccu

SEQ ID NO: 8742 - RNA, 19 nt, Artificial Sequence
  Description of Artificial Sequence: Synthetic oligonucleotide
agggcuccagcucugacca

SEQ ID NO: 8743 - RNA, 19 nt, Artificial Sequence
  Description of Artificial Sequence: Synthetic oligonucleotide
ggucagagcuggagcccua

SEQ ID NO: 8744 - RNA, 19 nt, Artificial Sequence
  Description of Artificial Sequence: Synthetic oligonucleotide
uagggcuccagcucugacc

SEQ ID NO: 8745 - RNA, 19 nt, Artificial Sequence
  Description of Artificial Sequence: Synthetic oligonucleotide
gucagagcuggagcccuac

SEQ ID NO: 8746 - RNA, 19 nt, Artificial Sequence
  Description of Artificial Sequence: Synthetic oligonucleotide
guagggcuccagcucugac

SEQ ID NO: 8747 - RNA, 19 nt, Artificial Sequence
  Description of Artificial Sequence: Synthetic oligonucleotide
caaggguaagaggccuaua

SEQ ID NO: 8748 - RNA, 19 nt, Artificial Sequence
  Description of Artificial Sequence: Synthetic oligonucleotide
uauaggccucuuacccuug

SEQ ID NO: 8749 - RNA, 19 nt, Artificial Sequence
  Description of Artificial Sequence: Synthetic oligonucleotide
aaggguaagaggccuauac

SEQ ID NO: 8750 - RNA, 19 nt, Artificial Sequence
  Description of Artificial Sequence: Synthetic oligonucleotide
guauaggccucuuacccuu

SEQ ID NO: 8751 - RNA, 19 nt, Artificial Sequence
  Description of Artificial Sequence: Synthetic oligonucleotide
aggguaagaggccuauacu

SEQ ID NO: 8752 - RNA, 19 nt, Artificial Sequence
  Description of Artificial Sequence: Synthetic oligonucleotide
aguauaggccucuuacccu

SEQ ID NO: 8753 - RNA, 19 nt, Artificial Sequence
  Description of Artificial Sequence: Synthetic oligonucleotide
ggguaagaggccuauacug

SEQ ID NO: 8754 - RNA, 19 nt, Artificial Sequence
  Description of Artificial Sequence: Synthetic oligonucleotide
caguauaggccucuuaccc

SEQ ID NO: 8755 - RNA, 19 nt, Artificial Sequence
  Description of Artificial Sequence: Synthetic oligonucleotide
gguaagaggccuauacugg

SEQ ID NO: 8756 - RNA, 19 nt, Artificial Sequence
  Description of Artificial Sequence: Synthetic oligonucleotide
ccaguauaggccucuuacc

SEQ ID NO: 8757 - RNA, 19 nt, Artificial Sequence
  Description of Artificial Sequence: Synthetic oligonucleotide
guaagaggccuauacuggg

SEQ ID NO: 8758 - RNA, 19 nt, Artificial Sequence
  Description of Artificial Sequence: Synthetic oligonucleotide
cccaguauaggccucuuac

SEQ ID NO: 8759 - RNA, 19 nt, Artificial Sequence
  Description of Artificial Sequence: Synthetic oligonucleotide
gggcugcuuccaaugccug

SEQ ID NO: 8760 - RNA, 19 nt, Artificial Sequence
  Description of Artificial Sequence: Synthetic oligonucleotide
caggcauuggaagcagccc

SEQ ID NO: 8761 - RNA, 19 nt, Artificial Sequence
  Description of Artificial Sequence: Synthetic oligonucleotide
ggcugcuuccaaugccugu

SEQ ID NO: 8762 - RNA, 19 nt, Artificial Sequence
  Description of Artificial Sequence: Synthetic oligonucleotide
acaggcauuggaagcagcc

SEQ ID NO: 8763 - RNA, 19 nt, Artificial Sequence
  Description of Artificial Sequence: Synthetic oligonucleotide
gcugcuuccaaugccuguc

SEQ ID NO: 8764 - RNA, 19 nt, Artificial Sequence
  Description of Artificial Sequence: Synthetic oligonucleotide
gacaggcauuggaagcagc

SEQ ID NO: 8765 - RNA, 19 nt, Artificial Sequence
  Description of Artificial Sequence: Synthetic oligonucleotide
cugcuuccaaugccugucc

SEQ ID NO: 8766 - RNA, 19 nt, Artificial Sequence
  Description of Artificial Sequence: Synthetic oligonucleotide
ggacaggcauuggaagcag

SEQ ID NO: 8767 - RNA, 19 nt, Artificial Sequence
  Description of Artificial Sequence: Synthetic oligonucleotide
ugcuuccaaugccuguccu

SEQ ID NO: 8768 - RNA, 19 nt, Artificial Sequence
  Description of Artificial Sequence: Synthetic oligonucleotide
aggacaggcauuggaagca

SEQ ID NO: 8769 - RNA, 19 nt, Artificial Sequence
  Description of Artificial Sequence: Synthetic oligonucleotide
gcuuccaaugccuguccuu

SEQ ID NO: 8770 - RNA, 19 nt, Artificial Sequence
  Description of Artificial Sequence: Synthetic oligonucleotide
aaggacaggcauuggaagc

SEQ ID NO: 8771 - RNA, 19 nt, Artificial Sequence
  Description of Artificial Sequence: Synthetic oligonucleotide
cuuccaaugccuguccuuu

SEQ ID NO: 8772 - RNA, 19 nt, Artificial Sequence
  Description of Artificial Sequence: Synthetic oligonucleotide
aaaggacaggcauuggaag

SEQ ID NO: 8773 - RNA, 19 nt, Artificial Sequence
  Description of Artificial Sequence: Synthetic oligonucleotide
uuccaaugccuguccuuua

SEQ ID NO: 8774 - RNA, 19 nt, Artificial Sequence
  Description of Artificial Sequence: Synthetic oligonucleotide
uaaaggacaggcauuggaa

SEQ ID NO: 8775 - RNA, 19 nt, Artificial Sequence
  Description of Artificial Sequence: Synthetic oligonucleotide
uccaaugccuguccuuuag

SEQ ID NO: 8776 - RNA, 19 nt, Artificial Sequence
  Description of Artificial Sequence: Synthetic oligonucleotide
cuaaaggacaggcauugga

SEQ ID NO: 8777 - RNA, 19 nt, Artificial Sequence
  Description of Artificial Sequence: Synthetic oligonucleotide
caaugccuguccuuuagag

SEQ ID NO: 8778 - RNA, 19 nt, Artificial Sequence
  Description of Artificial Sequence: Synthetic oligonucleotide
cucuaaaggacaggcauug

SEQ ID NO: 8779 - RNA, 19 nt, Artificial Sequence
  Description of Artificial Sequence: Synthetic oligonucleotide
aaugccuguccuuuagagc

SEQ ID NO: 8780 - RNA, 19 nt, Artificial Sequence
  Description of Artificial Sequence: Synthetic oligonucleotide
gcucuaaaggacaggcauu

SEQ ID NO: 8781 - RNA, 19 nt, Artificial Sequence
  Description of Artificial Sequence: Synthetic oligonucleotide
augccuguccuuuagagcu

SEQ ID NO: 8782 - RNA, 19 nt, Artificial Sequence
  Description of Artificial Sequence: Synthetic oligonucleotide
agcucuaaaggacaggcau

SEQ ID NO: 8783 - RNA, 19 nt, Artificial Sequence
  Description of Artificial Sequence: Synthetic oligonucleotide
cuuccucucuagcuuaacc

SEQ ID NO: 8784 - RNA, 19 nt, Artificial Sequence
  Description of Artificial Sequence: Synthetic oligonucleotide
gguuaagcuagagaggaag

SEQ ID NO: 8785 - RNA, 19 nt, Artificial Sequence
  Description of Artificial Sequence: Synthetic oligonucleotide
uuccucucuagcuuaaccc

SEQ ID NO: 8786 - RNA, 19 nt, Artificial Sequence
  Description of Artificial Sequence: Synthetic oligonucleotide
ggguuaagcuagagaggaa

SEQ ID NO: 8787 - RNA, 19 nt, Artificial Sequence
  Description of Artificial Sequence: Synthetic oligonucleotide
ucucuagcuuaacccugau

SEQ ID NO: 8788 - RNA, 19 nt, Artificial Sequence
  Description of Artificial Sequence: Synthetic oligonucleotide
aucaggguuaagcuagaga

SEQ ID NO: 8789 - RNA, 19 nt, Artificial Sequence
  Description of Artificial Sequence: Synthetic oligonucleotide
uagcuuaacccugauccug

SEQ ID NO: 8790 - RNA, 19 nt, Artificial Sequence
  Description of Artificial Sequence: Synthetic oligonucleotide
caggaucaggguuaagcua

SEQ ID NO: 8791 - RNA, 19 nt, Artificial Sequence
  Description of Artificial Sequence: Synthetic oligonucleotide
gaccaggugcaggaggagu

SEQ ID NO: 8792 - RNA, 19 nt, Artificial Sequence
  Description of Artificial Sequence: Synthetic oligonucleotide
acuccuccugcaccugguc

SEQ ID NO: 8793 - RNA, 19 nt, Artificial Sequence
  Description of Artificial Sequence: Synthetic oligonucleotide
accaggugcaggaggaguu

SEQ ID NO: 8794 - RNA, 19 nt, Artificial Sequence
  Description of Artificial Sequence: Synthetic oligonucleotide
aacuccuccugcaccuggu

SEQ ID NO: 8795 - RNA, 19 nt, Artificial Sequence
  Description of Artificial Sequence: Synthetic oligonucleotide
ccaggugcaggaggaguug

SEQ ID NO: 8796 - RNA, 19 nt, Artificial Sequence
  Description of Artificial Sequence: Synthetic oligonucleotide
caacuccuccugcaccugg

SEQ ID NO: 8797 - RNA, 19 nt, Artificial Sequence
  Description of Artificial Sequence: Synthetic oligonucleotide
caggugcaggaggaguugu

SEQ ID NO: 8798 - RNA, 19 nt, Artificial Sequence
  Description of Artificial Sequence: Synthetic oligonucleotide
acaacuccuccugcaccug

SEQ ID NO: 8799 - RNA, 19 nt, Artificial Sequence
  Description of Artificial Sequence: Synthetic oligonucleotide
aggugcaggaggaguugug

SEQ ID NO: 8800 - RNA, 19 nt, Artificial Sequence
  Description of Artificial Sequence: Synthetic oligonucleotide
cacaacuccuccugcaccu

SEQ ID NO: 8801 - RNA, 19 nt, Artificial Sequence
  Description of Artificial Sequence: Synthetic oligonucleotide
ugcaggaggaguuguggaa

SEQ ID NO: 8802 - RNA, 19 nt, Artificial Sequence
  Description of Artificial Sequence: Synthetic oligonucleotide
uuccacaacuccuccugca

SEQ ID NO: 8803 - RNA, 19 nt, Artificial Sequence
  Description of Artificial Sequence: Synthetic oligonucleotide
gcaggaggaguuguggaau

SEQ ID NO: 8804 - RNA, 19 nt, Artificial Sequence
  Description of Artificial Sequence: Synthetic oligonucleotide
auuccacaacuccuccugc

SEQ ID NO: 8805 - RNA, 19 nt, Artificial Sequence
  Description of Artificial Sequence: Synthetic oligonucleotide
aggaggaguuguggaauug

SEQ ID NO: 8806 - RNA, 19 nt, Artificial Sequence
  Description of Artificial Sequence: Synthetic oligonucleotide
caauuccacaacuccuccu

SEQ ID NO: 8807 - RNA, 19 nt, Artificial Sequence
  Description of Artificial Sequence: Synthetic oligonucleotide
ggaggaguuguggaauugu

SEQ ID NO: 8808 - RNA, 19 nt, Artificial Sequence
  Description of Artificial Sequence: Synthetic oligonucleotide
acaauuccacaacuccucc

SEQ ID NO: 8809 - RNA, 19 nt, Artificial Sequence
  Description of Artificial Sequence: Synthetic oligonucleotide
gaggaguuguggaauuguc

SEQ ID NO: 8810 - RNA, 19 nt, Artificial Sequence
  Description of Artificial Sequence: Synthetic oligonucleotide
gacaauuccacaacuccuc

SEQ ID NO: 8811 - RNA, 19 nt, Artificial Sequence
  Description of Artificial Sequence: Synthetic oligonucleotide
aggaguuguggaauuguca

SEQ ID NO: 8812 - RNA, 19 nt, Artificial Sequence
  Description of Artificial Sequence: Synthetic oligonucleotide
ugacaauuccacaacuccu

SEQ ID NO: 8813 - RNA, 19 nt, Artificial Sequence
  Description of Artificial Sequence: Synthetic oligonucleotide
ggaguuguggaauugucaa

SEQ ID NO: 8814 - RNA, 19 nt, Artificial Sequence
  Description of Artificial Sequence: Synthetic oligonucleotide
uugacaauuccacaacucc

SEQ ID NO: 8815 - RNA, 19 nt, Artificial Sequence
  Description of Artificial Sequence: Synthetic oligonucleotide
gaguuguggaauugucaag

SEQ ID NO: 8816 - RNA, 19 nt, Artificial Sequence
  Description of Artificial Sequence: Synthetic oligonucleotide
cuugacaauuccacaacuc

SEQ ID NO: 8817 - RNA, 19 nt, Artificial Sequence
  Description of Artificial Sequence: Synthetic oligonucleotide
aguuguggaauugucaagg

SEQ ID NO: 8818 - RNA, 19 nt, Artificial Sequence
  Description of Artificial Sequence: Synthetic oligonucleotide
ccuugacaauuccacaacu

SEQ ID NO: 8819 - RNA, 19 nt, Artificial Sequence
  Description of Artificial Sequence: Synthetic oligonucleotide
guuguggaauugucaagga

SEQ ID NO: 8820 - RNA, 19 nt, Artificial Sequence
  Description of Artificial Sequence: Synthetic oligonucleotide
uccuugacaauuccacaac

SEQ ID NO: 8821 - RNA, 19 nt, Artificial Sequence
  Description of Artificial Sequence: Synthetic oligonucleotide
uggaauugucaaggauguc

SEQ ID NO: 8822 - RNA, 19 nt, Artificial Sequence
  Description of Artificial Sequence: Synthetic oligonucleotide
gacauccuugacaauucca

SEQ ID NO: 8823 - RNA, 19 nt, Artificial Sequence
  Description of Artificial Sequence: Synthetic oligonucleotide
ggaauugucaaggauguca

SEQ ID NO: 8824 - RNA, 19 nt, Artificial Sequence
  Description of Artificial Sequence: Synthetic oligonucleotide
ugacauccuugacaauucc

SEQ ID NO: 8825 - RNA, 19 nt, Artificial Sequence
  Description of Artificial Sequence: Synthetic oligonucleotide
aguccaagcgagggagggu

SEQ ID NO: 8826 - RNA, 19 nt, Artificial Sequence
  Description of Artificial Sequence: Synthetic oligonucleotide
acccucccucgcuuggacu

SEQ ID NO: 8827 - RNA, 19 nt, Artificial Sequence
  Description of Artificial Sequence: Synthetic oligonucleotide
caagcgagggagggucuga

SEQ ID NO: 8828 - RNA, 19 nt, Artificial Sequence
  Description of Artificial Sequence: Synthetic oligonucleotide
ucagacccucccucgcuug

SEQ ID NO: 8829 - RNA, 19 nt, Artificial Sequence
  Description of Artificial Sequence: Synthetic oligonucleotide
aagcgagggagggucugac

SEQ ID NO: 8830 - RNA, 19 nt, Artificial Sequence
  Description of Artificial Sequence: Synthetic oligonucleotide
gucagacccucccucgcuu

SEQ ID NO: 8831 - RNA, 19 nt, Artificial Sequence
  Description of Artificial Sequence: Synthetic oligonucleotide
cugacccagugcugaugga

SEQ ID NO: 8832 - RNA, 19 nt, Artificial Sequence
  Description of Artificial Sequence: Synthetic oligonucleotide
uccaucagcacugggucag

SEQ ID NO: 8833 - RNA, 19 nt, Artificial Sequence
  Description of Artificial Sequence: Synthetic oligonucleotide
agauuaguggugggugucu

SEQ ID NO: 8834 - RNA, 19 nt, Artificial Sequence
  Description of Artificial Sequence: Synthetic oligonucleotide
agacacccaccacuaaucu

SEQ ID NO: 8835 - RNA, 19 nt, Artificial Sequence
  Description of Artificial Sequence: Synthetic oligonucleotide
auuaguggugggugucugg

SEQ ID NO: 8836 - RNA, 19 nt, Artificial Sequence
  Description of Artificial Sequence: Synthetic oligonucleotide
ccagacacccaccacuaau

SEQ ID NO: 8837 - RNA, 19 nt, Artificial Sequence
  Description of Artificial Sequence: Synthetic oligonucleotide
uuaguggugggugucuggu

SEQ ID NO: 8838 - RNA, 19 nt, Artificial Sequence
  Description of Artificial Sequence: Synthetic oligonucleotide
accagacacccaccacuaa

SEQ ID NO: 8839 - RNA, 19 nt, Artificial Sequence
  Description of Artificial Sequence: Synthetic oligonucleotide
uaguggugggugucuggua

SEQ ID NO: 8840 - RNA, 19 nt, Artificial Sequence
  Description of Artificial Sequence: Synthetic oligonucleotide
uaccagacacccaccacua

SEQ ID NO: 8841 - RNA, 19 nt, Artificial Sequence
  Description of Artificial Sequence: Synthetic oligonucleotide
aguggugggugucugguau

SEQ ID NO: 8842 - RNA, 19 nt, Artificial Sequence
  Description of Artificial Sequence: Synthetic oligonucleotide
auaccagacacccaccacu

SEQ ID NO: 8843 - RNA, 19 nt, Artificial Sequence
  Description of Artificial Sequence: Synthetic oligonucleotide
guggugggugucugguaug

SEQ ID NO: 8844 - RNA, 19 nt, Artificial Sequence
  Description of Artificial Sequence: Synthetic oligonucleotide
cauaccagacacccaccac

SEQ ID NO: 8845 - RNA, 19 nt, Artificial Sequence
  Description of Artificial Sequence: Synthetic oligonucleotide
uggugggugucugguauga

SEQ ID NO: 8846 - RNA, 19 nt, Artificial Sequence
  Description of Artificial Sequence: Synthetic oligonucleotide
ucauaccagacacccacca

SEQ ID NO: 8847 - RNA, 19 nt, Artificial Sequence
  Description of Artificial Sequence: Synthetic oligonucleotide
ggugggugucugguaugag

SEQ ID NO: 8848 - RNA, 19 nt, Artificial Sequence
  Description of Artificial Sequence: Synthetic oligonucleotide
cucauaccagacacccacc

SEQ ID NO: 8849 - RNA, 19 nt, Artificial Sequence
  Description of Artificial Sequence: Synthetic oligonucleotide
gugggugucugguaugagg

SEQ ID NO: 8850 - RNA, 19 nt, Artificial Sequence
  Description of Artificial Sequence: Synthetic oligonucleotide
ccucauaccagacacccac

SEQ ID NO: 8851 - RNA, 19 nt, Artificial Sequence
  Description of Artificial Sequence: Synthetic oligonucleotide
ugggugucugguaugagga

SEQ ID NO: 8852 - RNA, 19 nt, Artificial Sequence
  Description of Artificial Sequence: Synthetic oligonucleotide
uccucauaccagacaccca

SEQ ID NO: 8853 - RNA, 19 nt, Artificial Sequence
  Description of Artificial Sequence: Synthetic oligonucleotide
gggugucugguaugaggau

SEQ ID NO: 8854 - RNA, 19 nt, Artificial Sequence
  Description of Artificial Sequence: Synthetic oligonucleotide
auccucauaccagacaccc

SEQ ID NO: 8855 - RNA, 19 nt, Artificial Sequence
  Description of Artificial Sequence: Synthetic oligonucleotide
ggugucugguaugaggauc

SEQ ID NO: 8856 - RNA, 19 nt, Artificial Sequence
  Description of Artificial Sequence: Synthetic oligonucleotide
gauccucauaccagacacc

SEQ ID NO: 8857 - RNA, 19 nt, Artificial Sequence
  Description of Artificial Sequence: Synthetic oligonucleotide
gugucugguaugaggaucu

SEQ ID NO: 8858 - RNA, 19 nt, Artificial Sequence
  Description of Artificial Sequence: Synthetic oligonucleotide
agauccucauaccagacac

SEQ ID NO: 8859 - RNA, 19 nt, Artificial Sequence
  Description of Artificial Sequence: Synthetic oligonucleotide
ugucugguaugaggaucua

SEQ ID NO: 8860 - RNA, 19 nt, Artificial Sequence
  Description of Artificial Sequence: Synthetic oligonucleotide
uagauccucauaccagaca

SEQ ID NO: 8861 - RNA, 19 nt, Artificial Sequence
  Description of Artificial Sequence: Synthetic oligonucleotide
caaggguguccuacagagu

SEQ ID NO: 8862 - RNA, 19 nt, Artificial Sequence
  Description of Artificial Sequence: Synthetic oligonucleotide
acucuguaggacacccuug

SEQ ID NO: 8863 - RNA, 19 nt, Artificial Sequence
  Description of Artificial Sequence: Synthetic oligonucleotide
aaggguguccuacagagug

SEQ ID NO: 8864 - RNA, 19 nt, Artificial Sequence
  Description of Artificial Sequence: Synthetic oligonucleotide
cacucuguaggacacccuu

SEQ ID NO: 8865 - RNA, 19 nt, Artificial Sequence
  Description of Artificial Sequence: Synthetic oligonucleotide
aggguguccuacagagugg

SEQ ID NO: 8866 - RNA, 19 nt, Artificial Sequence
  Description of Artificial Sequence: Synthetic oligonucleotide
ccacucuguaggacacccu

SEQ ID NO: 8867 - RNA, 19 nt, Artificial Sequence
  Description of Artificial Sequence: Synthetic oligonucleotide
ggguguccuacagagugga

SEQ ID NO: 8868 - RNA, 19 nt, Artificial Sequence
  Description of Artificial Sequence: Synthetic oligonucleotide
uccacucuguaggacaccc

SEQ ID NO: 8869 - RNA, 19 nt, Artificial Sequence
  Description of Artificial Sequence: Synthetic oligonucleotide
gguguccuacagaguggag

SEQ ID NO: 8870 - RNA, 19 nt, Artificial Sequence
  Description of Artificial Sequence: Synthetic oligonucleotide
cuccacucuguaggacacc

SEQ ID NO: 8871 - RNA, 19 nt, Artificial Sequence
  Description of Artificial Sequence: Synthetic oligonucleotide
uccuacagaguggagugcu

SEQ ID NO: 8872 - RNA, 19 nt, Artificial Sequence
  Description of Artificial Sequence: Synthetic oligonucleotide
agcacuccacucuguagga

SEQ ID NO: 8873 - RNA, 19 nt, Artificial Sequence
  Description of Artificial Sequence: Synthetic oligonucleotide
aguggagugcugucauaug

SEQ ID NO: 8874 - RNA, 19 nt, Artificial Sequence
  Description of Artificial Sequence: Synthetic oligonucleotide
cauaugacagcacuccacu

SEQ ID NO: 8875 - RNA, 19 nt, Artificial Sequence
  Description of Artificial Sequence: Synthetic oligonucleotide
guggagugcugucauaugg

SEQ ID NO: 8876 - RNA, 19 nt, Artificial Sequence
  Description of Artificial Sequence: Synthetic oligonucleotide
ccauaugacagcacuccac

SEQ ID NO: 8877 - RNA, 19 nt, Artificial Sequence
  Description of Artificial Sequence: Synthetic oligonucleotide
uggagugcugucauauggc

SEQ ID NO: 8878 - RNA, 19 nt, Artificial Sequence
  Description of Artificial Sequence: Synthetic oligonucleotide
gccauaugacagcacucca

SEQ ID NO: 8879 - RNA, 19 nt, Artificial Sequence
  Description of Artificial Sequence: Synthetic oligonucleotide
ggagugcugucauauggcc

SEQ ID NO: 8880 - RNA, 19 nt, Artificial Sequence
  Description of Artificial Sequence: Synthetic oligonucleotide
ggccauaugacagcacucc

SEQ ID NO: 8881 - RNA, 19 nt, Artificial Sequence
  Description of Artificial Sequence: Synthetic oligonucleotide
gagugcugucauauggccu

SEQ ID NO: 8882 - RNA, 19 nt, Artificial Sequence
  Description of Artificial Sequence: Synthetic oligonucleotide
aggccauaugacagcacuc

SEQ ID NO: 8883 - RNA, 19 nt, Artificial Sequence
  Description of Artificial Sequence: Synthetic oligonucleotide
agugcugucauauggccug

SEQ ID NO: 8884 - RNA, 19 nt, Artificial Sequence
  Description of Artificial Sequence: Synthetic oligonucleotide
caggccauaugacagcacu

SEQ ID NO: 8885 - RNA, 19 nt, Artificial Sequence
  Description of Artificial Sequence: Synthetic oligonucleotide
gugcugucauauggccugg

SEQ ID NO: 8886 - RNA, 19 nt, Artificial Sequence
  Description of Artificial Sequence: Synthetic oligonucleotide
ccaggccauaugacagcac

SEQ ID NO: 8887 - RNA, 19 nt, Artificial Sequence
  Description of Artificial Sequence: Synthetic oligonucleotide
ugcugucauauggccuggg

SEQ ID NO: 8888 - RNA, 19 nt, Artificial Sequence
  Description of Artificial Sequence: Synthetic oligonucleotide
cccaggccauaugacagca

SEQ ID NO: 8889 - RNA, 19 nt, Artificial Sequence
  Description of Artificial Sequence: Synthetic oligonucleotide
gcugucauauggccuggga

SEQ ID NO: 8890 - RNA, 19 nt, Artificial Sequence
  Description of Artificial Sequence: Synthetic oligonucleotide
ucccaggccauaugacagc

SEQ ID NO: 8891 - RNA, 19 nt, Artificial Sequence
  Description of Artificial Sequence: Synthetic oligonucleotide
cugucauauggccugggac

SEQ ID NO: 8892 - RNA, 19 nt, Artificial Sequence
  Description of Artificial Sequence: Synthetic oligonucleotide
gucccaggccauaugacag

SEQ ID NO: 8893 - RNA, 19 nt, Artificial Sequence
  Description of Artificial Sequence: Synthetic oligonucleotide
ugucauauggccugggacg

SEQ ID NO: 8894 - RNA, 19 nt, Artificial Sequence
  Description of Artificial Sequence: Synthetic oligonucleotide
cgucccaggccauaugaca

SEQ ID NO: 8895 - RNA, 19 nt, Artificial Sequence
  Description of Artificial Sequence: Synthetic oligonucleotide
gucauauggccugggacgg

SEQ ID NO: 8896 - RNA, 19 nt, Artificial Sequence
  Description of Artificial Sequence: Synthetic oligonucleotide
ccgucccaggccauaugac

SEQ ID NO: 8897 - RNA, 19 nt, Artificial Sequence
  Description of Artificial Sequence: Synthetic oligonucleotide
agaggcccaagcacagcaa

SEQ ID NO: 8898 - RNA, 19 nt, Artificial Sequence
  Description of Artificial Sequence: Synthetic oligonucleotide
uugcugugcuugggccucu

SEQ ID NO: 8899 - RNA, 19 nt, Artificial Sequence
  Description of Artificial Sequence: Synthetic oligonucleotide
gaggcccaagcacagcaag

SEQ ID NO: 8900 - RNA, 19 nt, Artificial Sequence
  Description of Artificial Sequence: Synthetic oligonucleotide
cuugcugugcuugggccuc

SEQ ID NO: 8901 - RNA, 19 nt, Artificial Sequence
  Description of Artificial Sequence: Synthetic oligonucleotide
aggcccaagcacagcaagg

SEQ ID NO: 8902 - RNA, 19 nt, Artificial Sequence
  Description of Artificial Sequence: Synthetic oligonucleotide
ccuugcugugcuugggccu

SEQ ID NO: 8903 - RNA, 19 nt, Artificial Sequence
  Description of Artificial Sequence: Synthetic oligonucleotide
ggcccaagcacagcaagga

SEQ ID NO: 8904 - RNA, 19 nt, Artificial Sequence
  Description of Artificial Sequence: Synthetic oligonucleotide
uccuugcugugcuugggcc

SEQ ID NO: 8905 - RNA, 19 nt, Artificial Sequence
  Description of Artificial Sequence: Synthetic oligonucleotide
ccaagcacagcaaggacau

SEQ ID NO: 8906 - RNA, 19 nt, Artificial Sequence
  Description of Artificial Sequence: Synthetic oligonucleotide
auguccuugcugugcuugg

SEQ ID NO: 8907 - RNA, 19 nt, Artificial Sequence
  Description of Artificial Sequence: Synthetic oligonucleotide
gcccgauucaccuuugacg

SEQ ID NO: 8908 - RNA, 19 nt, Artificial Sequence
  Description of Artificial Sequence: Synthetic oligonucleotide
cgucaaaggugaaucgggc

SEQ ID NO: 8909 - RNA, 19 nt, Artificial Sequence
  Description of Artificial Sequence: Synthetic oligonucleotide
gauucaccuuugacgugua

SEQ ID NO: 8910 - RNA, 19 nt, Artificial Sequence
  Description of Artificial Sequence: Synthetic oligonucleotide
uacacgucaaaggugaauc

SEQ ID NO: 8911 - RNA, 19 nt, Artificial Sequence
  Description of Artificial Sequence: Synthetic oligonucleotide
auucaccuuugacguguac

SEQ ID NO: 8912 - RNA, 19 nt, Artificial Sequence
  Description of Artificial Sequence: Synthetic oligonucleotide
guacacgucaaaggugaau

SEQ ID NO: 8913 - RNA, 19 nt, Artificial Sequence
  Description of Artificial Sequence: Synthetic oligonucleotide
uuggcagccugaaugucaa

SEQ ID NO: 8914 - RNA, 19 nt, Artificial Sequence
  Description of Artificial Sequence: Synthetic oligonucleotide
uugacauucaggcugccaa

SEQ ID NO: 8915 - RNA, 19 nt, Artificial Sequence
  Description of Artificial Sequence: Synthetic oligonucleotide
uggcagccugaaugucaaa

SEQ ID NO: 8916 - RNA, 19 nt, Artificial Sequence
  Description of Artificial Sequence: Synthetic oligonucleotide
uuugacauucaggcugcca

SEQ ID NO: 8917 - RNA, 19 nt, Artificial Sequence
  Description of Artificial Sequence: Synthetic oligonucleotide
ggcagccugaaugucaaag

SEQ ID NO: 8918 - RNA, 19 nt, Artificial Sequence
  Description of Artificial Sequence: Synthetic oligonucleotide
cuuugacauucaggcugcc

SEQ ID NO: 8919 - RNA, 19 nt, Artificial Sequence
  Description of Artificial Sequence: Synthetic oligonucleotide
gcagccugaaugucaaagc

SEQ ID NO: 8920 - RNA, 19 nt, Artificial Sequence
  Description of Artificial Sequence: Synthetic oligonucleotide
gcuuugacauucaggcugc

SEQ ID NO: 8921 - RNA, 19 nt, Artificial Sequence
  Description of Artificial Sequence: Synthetic oligonucleotide
cagccugaaugucaaagcc

SEQ ID NO: 8922 - RNA, 19 nt, Artificial Sequence
  Description of Artificial Sequence: Synthetic oligonucleotide
ggcuuugacauucaggcug

SEQ ID NO: 8923 - RNA, 19 nt, Artificial Sequence
  Description of Artificial Sequence: Synthetic oligonucleotide
agccugaaugucaaagcca

SEQ ID NO: 8924 - RNA, 19 nt, Artificial Sequence
  Description of Artificial Sequence: Synthetic oligonucleotide
uggcuuugacauucaggcu

SEQ ID NO: 8925 - RNA, 19 nt, Artificial Sequence
  Description of Artificial Sequence: Synthetic oligonucleotide
gccugaaugucaaagccac

SEQ ID NO: 8926 - RNA, 19 nt, Artificial Sequence
  Description of Artificial Sequence: Synthetic oligonucleotide
guggcuuugacauucaggc

SEQ ID NO: 8927 - RNA, 19 nt, Artificial Sequence
  Description of Artificial Sequence: Synthetic oligonucleotide
gucaaagccacauucuacg

SEQ ID NO: 8928 - RNA, 19 nt, Artificial Sequence
  Description of Artificial Sequence: Synthetic oligonucleotide
cguagaauguggcuuugac

SEQ ID NO: 8929 - RNA, 19 nt, Artificial Sequence
  Description of Artificial Sequence: Synthetic oligonucleotide
ucaaagccacauucuacgg

SEQ ID NO: 8930 - RNA, 19 nt, Artificial Sequence
  Description of Artificial Sequence: Synthetic oligonucleotide
ccguagaauguggcuuuga

SEQ ID NO: 8931 - RNA, 19 nt, Artificial Sequence
  Description of Artificial Sequence: Synthetic oligonucleotide
caaagccacauucuacggg

SEQ ID NO: 8932 - RNA, 19 nt, Artificial Sequence
  Description of Artificial Sequence: Synthetic oligonucleotide
cccguagaauguggcuuug

SEQ ID NO: 8933 - RNA, 19 nt, Artificial Sequence
  Description of Artificial Sequence: Synthetic oligonucleotide
aaagccacauucuacgggc

SEQ ID NO: 8934 - RNA, 19 nt, Artificial Sequence
  Description of Artificial Sequence: Synthetic oligonucleotide
gcccguagaauguggcuuu

SEQ ID NO: 8935 - RNA, 19 nt, Artificial Sequence
  Description of Artificial Sequence: Synthetic oligonucleotide
gccacauucuacgggcucu

SEQ ID NO: 8936 - RNA, 19 nt, Artificial Sequence
  Description of Artificial Sequence: Synthetic oligonucleotide
agagcccguagaauguggc

SEQ ID NO: 8937 - RNA, 19 nt, Artificial Sequence
  Description of Artificial Sequence: Synthetic oligonucleotide
ccacauucuacgggcucua

SEQ ID NO: 8938 - RNA, 19 nt, Artificial Sequence
  Description of Artificial Sequence: Synthetic oligonucleotide
uagagcccguagaaugugg

SEQ ID NO: 8939 - RNA, 19 nt, Artificial Sequence
  Description of Artificial Sequence: Synthetic oligonucleotide
cacauucuacgggcucuac

SEQ ID NO: 8940 - RNA, 19 nt, Artificial Sequence
  Description of Artificial Sequence: Synthetic oligonucleotide
guagagcccguagaaugug

SEQ ID NO: 8941 - RNA, 19 nt, Artificial Sequence
  Description of Artificial Sequence: Synthetic oligonucleotide
uucuacgggcucuacucua

SEQ ID NO: 8942 - RNA, 19 nt, Artificial Sequence
  Description of Artificial Sequence: Synthetic oligonucleotide
uagaguagagcccguagaa

SEQ ID NO: 8943 - RNA, 19 nt, Artificial Sequence
  Description of Artificial Sequence: Synthetic oligonucleotide
ucuacgggcucuacucuau

SEQ ID NO: 8944 - RNA, 19 nt, Artificial Sequence
  Description of Artificial Sequence: Synthetic oligonucleotide
auagaguagagcccguaga

SEQ ID NO: 8945 - RNA, 19 nt, Artificial Sequence
  Description of Artificial Sequence: Synthetic oligonucleotide
cuacgggcucuacucuaug

SEQ ID NO: 8946 - RNA, 19 nt, Artificial Sequence
  Description of Artificial Sequence: Synthetic oligonucleotide
cauagaguagagcccguag

SEQ ID NO: 8947 - RNA, 19 nt, Artificial Sequence
  Description of Artificial Sequence: Synthetic oligonucleotide
cucuaugaguugugacuuu

SEQ ID NO: 8948 - RNA, 19 nt, Artificial Sequence
  Description of Artificial Sequence: Synthetic oligonucleotide
aaagucacaacucauagag

SEQ ID NO: 8949 - RNA, 19 nt, Artificial Sequence
  Description of Artificial Sequence: Synthetic oligonucleotide
ucuaugaguugugacuuuc

SEQ ID NO: 8950 - RNA, 19 nt, Artificial Sequence
  Description of Artificial Sequence: Synthetic oligonucleotide
gaaagucacaacucauaga

SEQ ID NO: 8951 - RNA, 19 nt, Artificial Sequence
  Description of Artificial Sequence: Synthetic oligonucleotide
ugaguugugacuuucaagg

SEQ ID NO: 8952 - RNA, 19 nt, Artificial Sequence
  Description of Artificial Sequence: Synthetic oligonucleotide
ccuugaaagucacaacuca

SEQ ID NO: 8953 - RNA, 19 nt, Artificial Sequence
  Description of Artificial Sequence: Synthetic oligonucleotide
gaguugugacuuucaagga

SEQ ID NO: 8954 - RNA, 19 nt, Artificial Sequence
  Description of Artificial Sequence: Synthetic oligonucleotide
uccuugaaagucacaacuc

SEQ ID NO: 8955 - RNA, 19 nt, Artificial Sequence
  Description of Artificial Sequence: Synthetic oligonucleotide
aguugugacuuucaaggac

SEQ ID NO: 8956 - RNA, 19 nt, Artificial Sequence
  Description of Artificial Sequence: Synthetic oligonucleotide
guccuugaaagucacaacu

SEQ ID NO: 8957 - RNA, 19 nt, Artificial Sequence
  Description of Artificial Sequence: Synthetic oligonucleotide
guugugacuuucaaggacu

SEQ ID NO: 8958 - RNA, 19 nt, Artificial Sequence
  Description of Artificial Sequence: Synthetic oligonucleotide
aguccuugaaagucacaac

SEQ ID NO: 8959 - RNA, 19 nt, Artificial Sequence
  Description of Artificial Sequence: Synthetic oligonucleotide
gacuuucaaggacuuggcc

SEQ ID NO: 8960 - RNA, 19 nt, Artificial Sequence
  Description of Artificial Sequence: Synthetic oligonucleotide
ggccaaguccuugaaaguc

SEQ ID NO: 8961 - RNA, 19 nt, Artificial Sequence
  Description of Artificial Sequence: Synthetic oligonucleotide
uuucaaggacuuggcccaa

SEQ ID NO: 8962 - RNA, 19 nt, Artificial Sequence
  Description of Artificial Sequence: Synthetic oligonucleotide
uugggccaaguccuugaaa

SEQ ID NO: 8963 - RNA, 19 nt, Artificial Sequence
  Description of Artificial Sequence: Synthetic oligonucleotide
uucaaggacuuggcccaaa

SEQ ID NO: 8964 - RNA, 19 nt, Artificial Sequence
  Description of Artificial Sequence: Synthetic oligonucleotide
uuugggccaaguccuugaa

SEQ ID NO: 8965 - RNA, 19 nt, Artificial Sequence
  Description of Artificial Sequence: Synthetic oligonucleotide
cccuacaguuggauagucc

SEQ ID NO: 8966 - RNA, 19 nt, Artificial Sequence
  Description of Artificial Sequence: Synthetic oligonucleotide
ggacuauccaacuguaggg

SEQ ID NO: 8967 - RNA, 19 nt, Artificial Sequence
  Description of Artificial Sequence: Synthetic oligonucleotide
ccuacaguuggauaguccc

SEQ ID NO: 8968 - RNA, 19 nt, Artificial Sequence
  Description of Artificial Sequence: Synthetic oligonucleotide
gggacuauccaacuguagg

SEQ ID NO: 8969 - RNA, 19 nt, Artificial Sequence
  Description of Artificial Sequence: Synthetic oligonucleotide
auucguccucuugcaccca

SEQ ID NO: 8970 - RNA, 19 nt, Artificial Sequence
  Description of Artificial Sequence: Synthetic oligonucleotide
ugggugcaagaggacgaau

SEQ ID NO: 8971 - RNA, 19 nt, Artificial Sequence
  Description of Artificial Sequence: Synthetic oligonucleotide
uucguccucuugcacccac

SEQ ID NO: 8972 - RNA, 19 nt, Artificial Sequence
  Description of Artificial Sequence: Synthetic oligonucleotide
gugggugcaagaggacgaa

SEQ ID NO: 8973 - RNA, 19 nt, Artificial Sequence
  Description of Artificial Sequence: Synthetic oligonucleotide
uccucuugcacccaccuac

SEQ ID NO: 8974 - RNA, 19 nt, Artificial Sequence
  Description of Artificial Sequence: Synthetic oligonucleotide
guaggugggugcaagagga

SEQ ID NO: 8975 - RNA, 19 nt, Artificial Sequence
  Description of Artificial Sequence: Synthetic oligonucleotide
ccucuugcacccaccuacc

SEQ ID NO: 8976 - RNA, 19 nt, Artificial Sequence
  Description of Artificial Sequence: Synthetic oligonucleotide
gguaggugggugcaagagg

SEQ ID NO: 8977 - RNA, 19 nt, Artificial Sequence
  Description of Artificial Sequence: Synthetic oligonucleotide
cucuugcacccaccuaccc

SEQ ID NO: 8978 - RNA, 19 nt, Artificial Sequence
  Description of Artificial Sequence: Synthetic oligonucleotide
ggguaggugggugcaagag

SEQ ID NO: 8979 - RNA, 19 nt, Artificial Sequence
  Description of Artificial Sequence: Synthetic oligonucleotide
cuaguuagcucuugcuugu

SEQ ID NO: 8980 - RNA, 19 nt, Artificial Sequence
  Description of Artificial Sequence: Synthetic oligonucleotide
acaagcaagagcuaacuag

SEQ ID NO: 8981 - RNA, 19 nt, Artificial Sequence
  Description of Artificial Sequence: Synthetic oligonucleotide
uaguuagcucuugcuugug

SEQ ID NO: 8982 - RNA, 19 nt, Artificial Sequence
  Description of Artificial Sequence: Synthetic oligonucleotide
cacaagcaagagcuaacua

SEQ ID NO: 8983 - RNA, 19 nt, Artificial Sequence
  Description of Artificial Sequence: Synthetic oligonucleotide
aguuagcucuugcuugugg

SEQ ID NO: 8984 - RNA, 19 nt, Artificial Sequence
  Description of Artificial Sequence: Synthetic oligonucleotide
ccacaagcaagagcuaacu

SEQ ID NO: 8985 - RNA, 19 nt, Artificial Sequence
  Description of Artificial Sequence: Synthetic oligonucleotide
uuagcucuugcuuguggaa

SEQ ID NO: 8986 - RNA, 19 nt, Artificial Sequence
  Description of Artificial Sequence: Synthetic oligonucleotide
uuccacaagcaagagcuaa

SEQ ID NO: 8987 - RNA, 19 nt, Artificial Sequence
  Description of Artificial Sequence: Synthetic oligonucleotide
uccucaucucccagcuuga

SEQ ID NO: 8988 - RNA, 19 nt, Artificial Sequence
  Description of Artificial Sequence: Synthetic oligonucleotide
ucaagcugggagaugagga

SEQ ID NO: 8989 - RNA, 19 nt, Artificial Sequence
  Description of Artificial Sequence: Synthetic oligonucleotide
aucucccagcuugauggcu

SEQ ID NO: 8990 - RNA, 19 nt, Artificial Sequence
  Description of Artificial Sequence: Synthetic oligonucleotide
agccaucaagcugggagau

SEQ ID NO: 8991 - RNA, 19 nt, Artificial Sequence
  Description of Artificial Sequence: Synthetic oligonucleotide
ucucccagcuugauggcuu

SEQ ID NO: 8992 - RNA, 19 nt, Artificial Sequence
  Description of Artificial Sequence: Synthetic oligonucleotide
aagccaucaagcugggaga

SEQ ID NO: 8993 - RNA, 19 nt, Artificial Sequence
  Description of Artificial Sequence: Synthetic oligonucleotide
cucccagcuugauggcuuc

SEQ ID NO: 8994 - RNA, 19 nt, Artificial Sequence
  Description of Artificial Sequence: Synthetic oligonucleotide
gaagccaucaagcugggag

SEQ ID NO: 8995 - RNA, 19 nt, Artificial Sequence
  Description of Artificial Sequence: Synthetic oligonucleotide
ucccagcuugauggcuucc

SEQ ID NO: 8996 - RNA, 19 nt, Artificial Sequence
  Description of Artificial Sequence: Synthetic oligonucleotide
ggaagccaucaagcuggga

SEQ ID NO: 8997 - RNA, 19 nt, Artificial Sequence
  Description of Artificial Sequence: Synthetic oligonucleotide
cccagcuugauggcuuccu

SEQ ID NO: 8998 - RNA, 19 nt, Artificial Sequence
  Description of Artificial Sequence: Synthetic oligonucleotide
aggaagccaucaagcuggg

SEQ ID NO: 8999 - RNA, 19 nt, Artificial Sequence
  Description of Artificial Sequence: Synthetic oligonucleotide
ccagcuugauggcuuccuc

SEQ ID NO: 9000 - RNA, 19 nt, Artificial Sequence
  Description of Artificial Sequence: Synthetic oligonucleotide
gaggaagccaucaagcugg

SEQ ID NO: 9001 - RNA, 19 nt, Artificial Sequence
  Description of Artificial Sequence: Synthetic oligonucleotide
ugauggcuuccucccaagu

SEQ ID NO: 9002 - RNA, 19 nt, Artificial Sequence
  Description of Artificial Sequence: Synthetic oligonucleotide
acuugggaggaagccauca

SEQ ID NO: 9003 - RNA, 19 nt, Artificial Sequence
  Description of Artificial Sequence: Synthetic oligonucleotide
gauggcuuccucccaaguu

SEQ ID NO: 9004 - RNA, 19 nt, Artificial Sequence
  Description of Artificial Sequence: Synthetic oligonucleotide
aacuugggaggaagccauc

SEQ ID NO: 9005 - RNA, 19 nt, Artificial Sequence
  Description of Artificial Sequence: Synthetic oligonucleotide
ggcuuccucccaaguuuuc

SEQ ID NO: 9006 - RNA, 19 nt, Artificial Sequence
  Description of Artificial Sequence: Synthetic oligonucleotide
gaaaacuugggaggaagcc

SEQ ID NO: 9007 - RNA, 19 nt, Artificial Sequence
  Description of Artificial Sequence: Synthetic oligonucleotide
ccucccaaguuuuccaaau

SEQ ID NO: 9008 - RNA, 19 nt, Artificial Sequence
  Description of Artificial Sequence: Synthetic oligonucleotide
auuuggaaaacuugggagg

SEQ ID NO: 9009 - RNA, 19 nt, Artificial Sequence
  Description of Artificial Sequence: Synthetic oligonucleotide
cccaaguuuuccaaaucau

SEQ ID NO: 9010 - RNA, 19 nt, Artificial Sequence
  Description of Artificial Sequence: Synthetic oligonucleotide
augauuuggaaaacuuggg

SEQ ID NO: 9011 - RNA, 19 nt, Artificial Sequence
  Description of Artificial Sequence: Synthetic oligonucleotide
ccaaguuuuccaaaucauc

SEQ ID NO: 9012 - RNA, 19 nt, Artificial Sequence
  Description of Artificial Sequence: Synthetic oligonucleotide
gaugauuuggaaaacuugg

SEQ ID NO: 9013 - RNA, 19 nt, Artificial Sequence
  Description of Artificial Sequence: Synthetic oligonucleotide
caaguuuuccaaaucaucu

SEQ ID NO: 9014 - RNA, 19 nt, Artificial Sequence
  Description of Artificial Sequence: Synthetic oligonucleotide
agaugauuuggaaaacuug

SEQ ID NO: 9015 - RNA, 19 nt, Artificial Sequence
  Description of Artificial Sequence: Synthetic oligonucleotide
aaguuuuccaaaucaucug

SEQ ID NO: 9016 - RNA, 19 nt, Artificial Sequence
  Description of Artificial Sequence: Synthetic oligonucleotide
cagaugauuuggaaaacuu

SEQ ID NO: 9017 - RNA, 19 nt, Artificial Sequence
  Description of Artificial Sequence: Synthetic oligonucleotide
guuuuccaaaucaucugau

SEQ ID NO: 9018 - RNA, 19 nt, Artificial Sequence
  Description of Artificial Sequence: Synthetic oligonucleotide
aucagaugauuuggaaaac

SEQ ID NO: 9019 - RNA, 19 nt, Artificial Sequence
  Description of Artificial Sequence: Synthetic oligonucleotide
aucugauuuccucuugucu

SEQ ID NO: 9020 - RNA, 19 nt, Artificial Sequence
  Description of Artificial Sequence: Synthetic oligonucleotide
agacaagaggaaaucagau

SEQ ID NO: 9021 - RNA, 19 nt, Artificial Sequence
  Description of Artificial Sequence: Synthetic oligonucleotide
ucugauuuccucuugucuc

SEQ ID NO: 9022 - RNA, 19 nt, Artificial Sequence
  Description of Artificial Sequence: Synthetic oligonucleotide
gagacaagaggaaaucaga

SEQ ID NO: 9023 - RNA, 19 nt, Artificial Sequence
  Description of Artificial Sequence: Synthetic oligonucleotide
cugauuuccucuugucucu

SEQ ID NO: 9024 - RNA, 19 nt, Artificial Sequence
  Description of Artificial Sequence: Synthetic oligonucleotide
agagacaagaggaaaucag

SEQ ID NO: 9025 - RNA, 19 nt, Artificial Sequence
  Description of Artificial Sequence: Synthetic oligonucleotide
cucuugucucugccauuca

SEQ ID NO: 9026 - RNA, 19 nt, Artificial Sequence
  Description of Artificial Sequence: Synthetic oligonucleotide
ugaauggcagagacaagag

SEQ ID NO: 9027 - RNA, 19 nt, Artificial Sequence
  Description of Artificial Sequence: Synthetic oligonucleotide
guuggaccuccacacugcu

SEQ ID NO: 9028 - RNA, 19 nt, Artificial Sequence
  Description of Artificial Sequence: Synthetic oligonucleotide
agcaguguggagguccaac

SEQ ID NO: 9029 - RNA, 19 nt, Artificial Sequence
  Description of Artificial Sequence: Synthetic oligonucleotide
ccacacugcugcaaggccu

SEQ ID NO: 9030 - RNA, 19 nt, Artificial Sequence
  Description of Artificial Sequence: Synthetic oligonucleotide
aggccuugcagcagugugg

SEQ ID NO: 9031 - RNA, 19 nt, Artificial Sequence
  Description of Artificial Sequence: Synthetic oligonucleotide
cacacugcugcaaggccug

SEQ ID NO: 9032 - RNA, 19 nt, Artificial Sequence
  Description of Artificial Sequence: Synthetic oligonucleotide
caggccuugcagcagugug

SEQ ID NO: 9033 - RNA, 19 nt, Artificial Sequence
  Description of Artificial Sequence: Synthetic oligonucleotide
acacugcugcaaggccugg

SEQ ID NO: 9034 - RNA, 19 nt, Artificial Sequence
  Description of Artificial Sequence: Synthetic oligonucleotide
ccaggccuugcagcagugu

SEQ ID NO: 9035 - RNA, 19 nt, Artificial Sequence
  Description of Artificial Sequence: Synthetic oligonucleotide
ugcaaggccugggccauau

SEQ ID NO: 9036 - RNA, 19 nt, Artificial Sequence
  Description of Artificial Sequence: Synthetic oligonucleotide
auauggcccaggccuugca

SEQ ID NO: 9037 - RNA, 19 nt, Artificial Sequence
  Description of Artificial Sequence: Synthetic oligonucleotide
gcaaggccugggccauaug

SEQ ID NO: 9038 - RNA, 19 nt, Artificial Sequence
  Description of Artificial Sequence: Synthetic oligonucleotide
cauauggcccaggccuugc

SEQ ID NO: 9039 - RNA, 19 nt, Artificial Sequence
  Description of Artificial Sequence: Synthetic oligonucleotide
caaggccugggccauaugu

SEQ ID NO: 9040 - RNA, 19 nt, Artificial Sequence
  Description of Artificial Sequence: Synthetic oligonucleotide
acauauggcccaggccuug

SEQ ID NO: 9041 - RNA, 19 nt, Artificial Sequence
  Description of Artificial Sequence: Synthetic oligonucleotide
aaggccugggccauauguu

SEQ ID NO: 9042 - RNA, 19 nt, Artificial Sequence
  Description of Artificial Sequence: Synthetic oligonucleotide
aacauauggcccaggccuu

SEQ ID NO: 9043 - RNA, 19 nt, Artificial Sequence
  Description of Artificial Sequence: Synthetic oligonucleotide
aggccugggccauauguug

SEQ ID NO: 9044 - RNA, 19 nt, Artificial Sequence
  Description of Artificial Sequence: Synthetic oligonucleotide
caacauauggcccaggccu

SEQ ID NO: 9045 - RNA, 19 nt, Artificial Sequence
  Description of Artificial Sequence: Synthetic oligonucleotide
ggccugggccauauguugc

SEQ ID NO: 9046 - RNA, 19 nt, Artificial Sequence
  Description of Artificial Sequence: Synthetic oligonucleotide
gcaacauauggcccaggcc

SEQ ID NO: 9047 - RNA, 19 nt, Artificial Sequence
  Description of Artificial Sequence: Synthetic oligonucleotide
gccugggccauauguugcu

SEQ ID NO: 9048 - RNA, 19 nt, Artificial Sequence
  Description of Artificial Sequence: Synthetic oligonucleotide
agcaacauauggcccaggc

SEQ ID NO: 9049 - RNA, 19 nt, Artificial Sequence
  Description of Artificial Sequence: Synthetic oligonucleotide
ccugggccauauguugcug

SEQ ID NO: 9050 - RNA, 19 nt, Artificial Sequence
  Description of Artificial Sequence: Synthetic oligonucleotide
cagcaacauauggcccagg

SEQ ID NO: 9051 - RNA, 19 nt, Artificial Sequence
  Description of Artificial Sequence: Synthetic oligonucleotide
ggccauauguugcugggaa

SEQ ID NO: 9052 - RNA, 19 nt, Artificial Sequence
  Description of Artificial Sequence: Synthetic oligonucleotide
uucccagcaacauauggcc

SEQ ID NO: 9053 - RNA, 19 nt, Artificial Sequence
  Description of Artificial Sequence: Synthetic oligonucleotide
ccauauguugcugggaauu

SEQ ID NO: 9054 - RNA, 19 nt, Artificial Sequence
  Description of Artificial Sequence: Synthetic oligonucleotide
aauucccagcaacauaugg

SEQ ID NO: 9055 - RNA, 19 nt, Artificial Sequence
  Description of Artificial Sequence: Synthetic oligonucleotide
ggaauuuccuccacccuuc

SEQ ID NO: 9056 - RNA, 19 nt, Artificial Sequence
  Description of Artificial Sequence: Synthetic oligonucleotide
gaaggguggaggaaauucc

SEQ ID NO: 9057 - RNA, 19 nt, Artificial Sequence
  Description of Artificial Sequence: Synthetic oligonucleotide
gaauuuccuccacccuucg

SEQ ID NO: 9058 - RNA, 19 nt, Artificial Sequence
  Description of Artificial Sequence: Synthetic oligonucleotide
cgaaggguggaggaaauuc

SEQ ID NO: 9059 - RNA, 19 nt, Artificial Sequence
  Description of Artificial Sequence: Synthetic oligonucleotide
aauuuccuccacccuucgu

SEQ ID NO: 9060 - RNA, 19 nt, Artificial Sequence
  Description of Artificial Sequence: Synthetic oligonucleotide
acgaaggguggaggaaauu

SEQ ID NO: 9061 - RNA, 19 nt, Artificial Sequence
  Description of Artificial Sequence: Synthetic oligonucleotide
auuuccuccacccuucguc

SEQ ID NO: 9062 - RNA, 19 nt, Artificial Sequence
  Description of Artificial Sequence: Synthetic oligonucleotide
gacgaaggguggaggaaau

SEQ ID NO: 9063 - RNA, 19 nt, Artificial Sequence
  Description of Artificial Sequence: Synthetic oligonucleotide
uuuccuccacccuucguca

SEQ ID NO: 9064 - RNA, 19 nt, Artificial Sequence
  Description of Artificial Sequence: Synthetic oligonucleotide
ugacgaaggguggaggaaa

SEQ ID NO: 9065 - RNA, 19 nt, Artificial Sequence
  Description of Artificial Sequence: Synthetic oligonucleotide
uuccuccacccuucgucau

SEQ ID NO: 9066 - RNA, 19 nt, Artificial Sequence
  Description of Artificial Sequence: Synthetic oligonucleotide
augacgaaggguggaggaa

SEQ ID NO: 9067 - RNA, 19 nt, Artificial Sequence
  Description of Artificial Sequence: Synthetic oligonucleotide
uccuccacccuucgucaug

SEQ ID NO: 9068 - RNA, 19 nt, Artificial Sequence
  Description of Artificial Sequence: Synthetic oligonucleotide
caugacgaaggguggagga

SEQ ID NO: 9069 - RNA, 19 nt, Artificial Sequence
  Description of Artificial Sequence: Synthetic oligonucleotide
ccuccacccuucgucaugc

SEQ ID NO: 9070 - RNA, 19 nt, Artificial Sequence
  Description of Artificial Sequence: Synthetic oligonucleotide
gcaugacgaaggguggagg

SEQ ID NO: 9071 - RNA, 19 nt, Artificial Sequence
  Description of Artificial Sequence: Synthetic oligonucleotide
cuccacccuucgucaugca

SEQ ID NO: 9072 - RNA, 19 nt, Artificial Sequence
  Description of Artificial Sequence: Synthetic oligonucleotide
ugcaugacgaaggguggag

SEQ ID NO: 9073 - RNA, 19 nt, Artificial Sequence
  Description of Artificial Sequence: Synthetic oligonucleotide
ccuucgucaugcaguggag

SEQ ID NO: 9074 - RNA, 19 nt, Artificial Sequence
  Description of Artificial Sequence: Synthetic oligonucleotide
cuccacugcaugacgaagg

SEQ ID NO: 9075 - RNA, 19 nt, Artificial Sequence
  Description of Artificial Sequence: Synthetic oligonucleotide
cuucgucaugcaguggagg

SEQ ID NO: 9076 - RNA, 19 nt, Artificial Sequence
  Description of Artificial Sequence: Synthetic oligonucleotide
ccuccacugcaugacgaag

SEQ ID NO: 9077 - RNA, 19 nt, Artificial Sequence
  Description of Artificial Sequence: Synthetic oligonucleotide
uucgucaugcaguggaggg

SEQ ID NO: 9078 - RNA, 19 nt, Artificial Sequence
  Description of Artificial Sequence: Synthetic oligonucleotide
cccuccacugcaugacgaa

SEQ ID NO: 9079 - RNA, 19 nt, Artificial Sequence
  Description of Artificial Sequence: Synthetic oligonucleotide
cgccuccauuccuacuaag

SEQ ID NO: 9080 - RNA, 19 nt, Artificial Sequence
  Description of Artificial Sequence: Synthetic oligonucleotide
cuuaguaggaauggaggcg

SEQ ID NO: 9081 - RNA, 19 nt, Artificial Sequence
  Description of Artificial Sequence: Synthetic oligonucleotide
gccuccauuccuacuaagg

SEQ ID NO: 9082 - RNA, 19 nt, Artificial Sequence
  Description of Artificial Sequence: Synthetic oligonucleotide
ccuuaguaggaauggaggc

SEQ ID NO: 9083 - RNA, 19 nt, Artificial Sequence
  Description of Artificial Sequence: Synthetic oligonucleotide
ccuccauuccuacuaaggg

SEQ ID NO: 9084 - RNA, 19 nt, Artificial Sequence
  Description of Artificial Sequence: Synthetic oligonucleotide
cccuuaguaggaauggagg

SEQ ID NO: 9085 - RNA, 19 nt, Artificial Sequence
  Description of Artificial Sequence: Synthetic oligonucleotide
cagaaucauuccaaccgac

SEQ ID NO: 9086 - RNA, 19 nt, Artificial Sequence
  Description of Artificial Sequence: Synthetic oligonucleotide
gucgguuggaaugauucug

SEQ ID NO: 9087 - RNA, 19 nt, Artificial Sequence
  Description of Artificial Sequence: Synthetic oligonucleotide
agaaucauuccaaccgacc

SEQ ID NO: 9088 - RNA, 19 nt, Artificial Sequence
  Description of Artificial Sequence: Synthetic oligonucleotide
ggucgguuggaaugauucu

SEQ ID NO: 9089 - RNA, 19 nt, Artificial Sequence
  Description of Artificial Sequence: Synthetic oligonucleotide
gaaucauuccaaccgaccc

SEQ ID NO: 9090 - RNA, 19 nt, Artificial Sequence
  Description of Artificial Sequence: Synthetic oligonucleotide
gggucgguuggaaugauuc

SEQ ID NO: 9091 - RNA, 19 nt, Artificial Sequence
  Description of Artificial Sequence: Synthetic oligonucleotide
aaucauuccaaccgaccca

SEQ ID NO: 9092 - RNA, 19 nt, Artificial Sequence
  Description of Artificial Sequence: Synthetic oligonucleotide
ugggucgguuggaaugauu

SEQ ID NO: 9093 - RNA, 19 nt, Artificial Sequence
  Description of Artificial Sequence: Synthetic oligonucleotide
aucauuccaaccgacccac

SEQ ID NO: 9094 - RNA, 19 nt, Artificial Sequence
  Description of Artificial Sequence: Synthetic oligonucleotide
gugggucgguuggaaugau

SEQ ID NO: 9095 - RNA, 19 nt, Artificial Sequence
  Description of Artificial Sequence: Synthetic oligonucleotide
ucauuccaaccgacccacu

SEQ ID NO: 9096 - RNA, 19 nt, Artificial Sequence
  Description of Artificial Sequence: Synthetic oligonucleotide
agugggucgguuggaauga

SEQ ID NO: 9097 - RNA, 19 nt, Artificial Sequence
  Description of Artificial Sequence: Synthetic oligonucleotide
uccaaccgacccacugcaa

SEQ ID NO: 9098 - RNA, 19 nt, Artificial Sequence
  Description of Artificial Sequence: Synthetic oligonucleotide
uugcagugggucgguugga

SEQ ID NO: 9099 - RNA, 19 nt, Artificial Sequence
  Description of Artificial Sequence: Synthetic oligonucleotide
ccaaccgacccacugcaaa

SEQ ID NO: 9100 - RNA, 19 nt, Artificial Sequence
  Description of Artificial Sequence: Synthetic oligonucleotide
uuugcagugggucgguugg

SEQ ID NO: 9101 - RNA, 19 nt, Artificial Sequence
  Description of Artificial Sequence: Synthetic oligonucleotide
caaccgacccacugcaaag

SEQ ID NO: 9102 - RNA, 19 nt, Artificial Sequence
  Description of Artificial Sequence: Synthetic oligonucleotide
cuuugcagugggucgguug

SEQ ID NO: 9103 - RNA, 19 nt, Artificial Sequence
  Description of Artificial Sequence: Synthetic oligonucleotide
aaccgacccacugcaaaga

SEQ ID NO: 9104 - RNA, 19 nt, Artificial Sequence
  Description of Artificial Sequence: Synthetic oligonucleotide
ucuuugcagugggucgguu

SEQ ID NO: 9105 - RNA, 19 nt, Artificial Sequence
  Description of Artificial Sequence: Synthetic oligonucleotide
accgacccacugcaaagac

SEQ ID NO: 9106 - RNA, 19 nt, Artificial Sequence
  Description of Artificial Sequence: Synthetic oligonucleotide
gucuuugcagugggucggu

SEQ ID NO: 9107 - RNA, 19 nt, Artificial Sequence
  Description of Artificial Sequence: Synthetic oligonucleotide
ccgacccacugcaaagacu

SEQ ID NO: 9108 - RNA, 19 nt, Artificial Sequence
  Description of Artificial Sequence: Synthetic oligonucleotide
agucuuugcagugggucgg

SEQ ID NO: 9109 - RNA, 19 nt, Artificial Sequence
  Description of Artificial Sequence: Synthetic oligonucleotide
cgacccacugcaaagacua

SEQ ID NO: 9110 - RNA, 19 nt, Artificial Sequence
  Description of Artificial Sequence: Synthetic oligonucleotide
uagucuuugcagugggucg

SEQ ID NO: 9111 - RNA, 19 nt, Artificial Sequence
  Description of Artificial Sequence: Synthetic oligonucleotide
gacccacugcaaagacuau

SEQ ID NO: 9112 - RNA, 19 nt, Artificial Sequence
  Description of Artificial Sequence: Synthetic oligonucleotide
auagucuuugcaguggguc

SEQ ID NO: 9113 - RNA, 19 nt, Artificial Sequence
  Description of Artificial Sequence: Synthetic oligonucleotide
acccacugcaaagacuaug

SEQ ID NO: 9114 - RNA, 19 nt, Artificial Sequence
  Description of Artificial Sequence: Synthetic oligonucleotide
cauagucuuugcagugggu

SEQ ID NO: 9115 - RNA, 19 nt, Artificial Sequence
  Description of Artificial Sequence: Synthetic oligonucleotide
acugcaaagacuaugacag

SEQ ID NO: 9116 - RNA, 19 nt, Artificial Sequence
  Description of Artificial Sequence: Synthetic oligonucleotide
cugucauagucuuugcagu

SEQ ID NO: 9117 - RNA, 19 nt, Artificial Sequence
  Description of Artificial Sequence: Synthetic oligonucleotide
cugcaaagacuaugacagc

SEQ ID NO: 9118 - RNA, 19 nt, Artificial Sequence
  Description of Artificial Sequence: Synthetic oligonucleotide
gcugucauagucuuugcag

SEQ ID NO: 9119 - RNA, 19 nt, Artificial Sequence
  Description of Artificial Sequence: Synthetic oligonucleotide
ugcaaagacuaugacagca

SEQ ID NO: 9120 - RNA, 19 nt, Artificial Sequence
  Description of Artificial Sequence: Synthetic oligonucleotide
ugcugucauagucuuugca

SEQ ID NO: 9121 - RNA, 19 nt, Artificial Sequence
  Description of Artificial Sequence: Synthetic oligonucleotide
gcaaagacuaugacagcau

SEQ ID NO: 9122 - RNA, 19 nt, Artificial Sequence
  Description of Artificial Sequence: Synthetic oligonucleotide
augcugucauagucuuugc

SEQ ID NO: 9123 - RNA, 19 nt, Artificial Sequence
  Description of Artificial Sequence: Synthetic oligonucleotide
aaagacuaugacagcauca

SEQ ID NO: 9124 - RNA, 19 nt, Artificial Sequence
  Description of Artificial Sequence: Synthetic oligonucleotide
ugaugcugucauagucuuu

SEQ ID NO: 9125 - RNA, 19 nt, Artificial Sequence
  Description of Artificial Sequence: Synthetic oligonucleotide
aagacuaugacagcaucaa

SEQ ID NO: 9126 - RNA, 19 nt, Artificial Sequence
  Description of Artificial Sequence: Synthetic oligonucleotide
uugaugcugucauagucuu

SEQ ID NO: 9127 - RNA, 19 nt, Artificial Sequence
  Description of Artificial Sequence: Synthetic oligonucleotide
agacuaugacagcaucaaa

SEQ ID NO: 9128 - RNA, 19 nt, Artificial Sequence
  Description of Artificial Sequence: Synthetic oligonucleotide
uuugaugcugucauagucu

SEQ ID NO: 9129 - RNA, 19 nt, Artificial Sequence
  Description of Artificial Sequence: Synthetic oligonucleotide
gacuaugacagcaucaaau

SEQ ID NO: 9130 - RNA, 19 nt, Artificial Sequence
  Description of Artificial Sequence: Synthetic oligonucleotide
auuugaugcugucauaguc

SEQ ID NO: 9131 - RNA, 19 nt, Artificial Sequence
  Description of Artificial Sequence: Synthetic oligonucleotide
cuaugacagcaucaaauuu

SEQ ID NO: 9132 - RNA, 19 nt, Artificial Sequence
  Description of Artificial Sequence: Synthetic oligonucleotide
aaauuugaugcugucauag

SEQ ID NO: 9133 - RNA, 19 nt, Artificial Sequence
  Description of Artificial Sequence: Synthetic oligonucleotide
uaugacagcaucaaauuuc

SEQ ID NO: 9134 - RNA, 19 nt, Artificial Sequence
  Description of Artificial Sequence: Synthetic oligonucleotide
gaaauuugaugcugucaua

SEQ ID NO: 9135 - RNA, 19 nt, Artificial Sequence
  Description of Artificial Sequence: Synthetic oligonucleotide
gcaucaaauuucaggaccu

SEQ ID NO: 9136 - RNA, 19 nt, Artificial Sequence
  Description of Artificial Sequence: Synthetic oligonucleotide
agguccugaaauuugaugc

SEQ ID NO: 9137 - RNA, 19 nt, Artificial Sequence
  Description of Artificial Sequence: Synthetic oligonucleotide
aucaaauuucaggaccugc

SEQ ID NO: 9138 - RNA, 19 nt, Artificial Sequence
  Description of Artificial Sequence: Synthetic oligonucleotide
gcagguccugaaauuugau

SEQ ID NO: 9139 - RNA, 19 nt, Artificial Sequence
  Description of Artificial Sequence: Synthetic oligonucleotide
ucaaauuucaggaccugca

SEQ ID NO: 9140 - RNA, 19 nt, Artificial Sequence
  Description of Artificial Sequence: Synthetic oligonucleotide
ugcagguccugaaauuuga

SEQ ID NO: 9141 - RNA, 19 nt, Artificial Sequence
  Description of Artificial Sequence: Synthetic oligonucleotide
uucaggaccugcagacagu

SEQ ID NO: 9142 - RNA, 19 nt, Artificial Sequence
  Description of Artificial Sequence: Synthetic oligonucleotide
acugucugcagguccugaa

SEQ ID NO: 9143 - RNA, 19 nt, Artificial Sequence
  Description of Artificial Sequence: Synthetic oligonucleotide
ucaggaccugcagacagua

SEQ ID NO: 9144 - RNA, 19 nt, Artificial Sequence
  Description of Artificial Sequence: Synthetic oligonucleotide
uacugucugcagguccuga

SEQ ID NO: 9145 - RNA, 19 nt, Artificial Sequence
  Description of Artificial Sequence: Synthetic oligonucleotide
caggaccugcagacaguac

SEQ ID NO: 9146 - RNA, 19 nt, Artificial Sequence
  Description of Artificial Sequence: Synthetic oligonucleotide
guacugucugcagguccug

SEQ ID NO: 9147 - RNA, 19 nt, Artificial Sequence
  Description of Artificial Sequence: Synthetic oligonucleotide
aggaccugcagacaguaca

SEQ ID NO: 9148 - RNA, 19 nt, Artificial Sequence
  Description of Artificial Sequence: Synthetic oligonucleotide
uguacugucugcagguccu

SEQ ID NO: 9149 - RNA, 19 nt, Artificial Sequence
  Description of Artificial Sequence: Synthetic oligonucleotide
ggaccugcagacaguacag

SEQ ID NO: 9150 - RNA, 19 nt, Artificial Sequence
  Description of Artificial Sequence: Synthetic oligonucleotide
cuguacugucugcaggucc

SEQ ID NO: 9151 - RNA, 19 nt, Artificial Sequence
  Description of Artificial Sequence: Synthetic oligonucleotide
cugcagacaguacaggcua

SEQ ID NO: 9152 - RNA, 19 nt, Artificial Sequence
  Description of Artificial Sequence: Synthetic oligonucleotide
uagccuguacugucugcag

SEQ ID NO: 9153 - RNA, 19 nt, Artificial Sequence
  Description of Artificial Sequence: Synthetic oligonucleotide
gacaguacaggcuagauaa

SEQ ID NO: 9154 - RNA, 19 nt, Artificial Sequence
  Description of Artificial Sequence: Synthetic oligonucleotide
uuaucuagccuguacuguc

SEQ ID NO: 9155 - RNA, 19 nt, Artificial Sequence
  Description of Artificial Sequence: Synthetic oligonucleotide
acaguacaggcuagauaac

SEQ ID NO: 9156 - RNA, 19 nt, Artificial Sequence
  Description of Artificial Sequence: Synthetic oligonucleotide
guuaucuagccuguacugu

SEQ ID NO: 9157 - RNA, 19 nt, Artificial Sequence
  Description of Artificial Sequence: Synthetic oligonucleotide
caguacaggcuagauaacc

SEQ ID NO: 9158 - RNA, 19 nt, Artificial Sequence
  Description of Artificial Sequence: Synthetic oligonucleotide
gguuaucuagccuguacug

SEQ ID NO: 9159 - RNA, 19 nt, Artificial Sequence
  Description of Artificial Sequence: Synthetic oligonucleotide
aguacaggcuagauaaccc

SEQ ID NO: 9160 - RNA, 19 nt, Artificial Sequence
  Description of Artificial Sequence: Synthetic oligonucleotide
ggguuaucuagccuguacu

SEQ ID NO: 9161 - RNA, 19 nt, Artificial Sequence
  Description of Artificial Sequence: Synthetic oligonucleotide
guacaggcuagauaaccca

SEQ ID NO: 9162 - RNA, 19 nt, Artificial Sequence
  Description of Artificial Sequence: Synthetic oligonucleotide
uggguuaucuagccuguac

SEQ ID NO: 9163 - RNA, 19 nt, Artificial Sequence
  Description of Artificial Sequence: Synthetic oligonucleotide
uacaggcuagauaacccac

SEQ ID NO: 9164 - RNA, 19 nt, Artificial Sequence
  Description of Artificial Sequence: Synthetic oligonucleotide
guggguuaucuagccugua

SEQ ID NO: 9165 - RNA, 19 nt, Artificial Sequence
  Description of Artificial Sequence: Synthetic oligonucleotide
gcuagauaacccacccaau

SEQ ID NO: 9166 - RNA, 19 nt, Artificial Sequence
  Description of Artificial Sequence: Synthetic oligonucleotide
auuggguggguuaucuagc

SEQ ID NO: 9167 - RNA, 19 nt, Artificial Sequence
  Description of Artificial Sequence: Synthetic oligonucleotide
cuagauaacccacccaauu

SEQ ID NO: 9168 - RNA, 19 nt, Artificial Sequence
  Description of Artificial Sequence: Synthetic oligonucleotide
aauuggguggguuaucuag

SEQ ID NO: 9169 - RNA, 19 nt, Artificial Sequence
  Description of Artificial Sequence: Synthetic oligonucleotide
agauaacccacccaauuuc

SEQ ID NO: 9170 - RNA, 19 nt, Artificial Sequence
  Description of Artificial Sequence: Synthetic oligonucleotide
gaaauuggguggguuaucu

SEQ ID NO: 9171 - RNA, 19 nt, Artificial Sequence
  Description of Artificial Sequence: Synthetic oligonucleotide
gauaacccacccaauuucc

SEQ ID NO: 9172 - RNA, 19 nt, Artificial Sequence
  Description of Artificial Sequence: Synthetic oligonucleotide
ggaaauuggguggguuauc

SEQ ID NO: 9173 - RNA, 19 nt, Artificial Sequence
  Description of Artificial Sequence: Synthetic oligonucleotide
aaccuuucagcauaacgcc

SEQ ID NO: 9174 - RNA, 19 nt, Artificial Sequence
  Description of Artificial Sequence: Synthetic oligonucleotide
ggcguuaugcugaaagguu

SEQ ID NO: 9175 - RNA, 19 nt, Artificial Sequence
  Description of Artificial Sequence: Synthetic oligonucleotide
accuuucagcauaacgccu

SEQ ID NO: 9176 - RNA, 19 nt, Artificial Sequence
  Description of Artificial Sequence: Synthetic oligonucleotide
aggcguuaugcugaaaggu

SEQ ID NO: 9177 - RNA, 19 nt, Artificial Sequence
  Description of Artificial Sequence: Synthetic oligonucleotide
ccuuucagcauaacgccuc

SEQ ID NO: 9178 - RNA, 19 nt, Artificial Sequence
  Description of Artificial Sequence: Synthetic oligonucleotide
gaggcguuaugcugaaagg

SEQ ID NO: 9179 - RNA, 19 nt, Artificial Sequence
  Description of Artificial Sequence: Synthetic oligonucleotide
cuuucagcauaacgccuca

SEQ ID NO: 9180 - RNA, 19 nt, Artificial Sequence
  Description of Artificial Sequence: Synthetic oligonucleotide
ugaggcguuaugcugaaag

SEQ ID NO: 9181 - RNA, 19 nt, Artificial Sequence
  Description of Artificial Sequence: Synthetic oligonucleotide
uuucagcauaacgccucac

SEQ ID NO: 9182 - RNA, 19 nt, Artificial Sequence
  Description of Artificial Sequence: Synthetic oligonucleotide
gugaggcguuaugcugaaa

SEQ ID NO: 9183 - RNA, 19 nt, Artificial Sequence
  Description of Artificial Sequence: Synthetic oligonucleotide
uucagcauaacgccucaca

SEQ ID NO: 9184 - RNA, 19 nt, Artificial Sequence
  Description of Artificial Sequence: Synthetic oligonucleotide
ugugaggcguuaugcugaa

SEQ ID NO: 9185 - RNA, 19 nt, Artificial Sequence
  Description of Artificial Sequence: Synthetic oligonucleotide
ucagcauaacgccucacau

SEQ ID NO: 9186 - RNA, 19 nt, Artificial Sequence
  Description of Artificial Sequence: Synthetic oligonucleotide
augugaggcguuaugcuga

SEQ ID NO: 9187 - RNA, 19 nt, Artificial Sequence
  Description of Artificial Sequence: Synthetic oligonucleotide
cagcauaacgccucacauc

SEQ ID NO: 9188 - RNA, 19 nt, Artificial Sequence
  Description of Artificial Sequence: Synthetic oligonucleotide
gaugugaggcguuaugcug

SEQ ID NO: 9189 - RNA, 19 nt, Artificial Sequence
  Description of Artificial Sequence: Synthetic oligonucleotide
agcauaacgccucacaucc

SEQ ID NO: 9190 - RNA, 19 nt, Artificial Sequence
  Description of Artificial Sequence: Synthetic oligonucleotide
ggaugugaggcguuaugcu

SEQ ID NO: 9191 - RNA, 19 nt, Artificial Sequence
  Description of Artificial Sequence: Synthetic oligonucleotide
gcauaacgccucacauccc

SEQ ID NO: 9192 - RNA, 19 nt, Artificial Sequence
  Description of Artificial Sequence: Synthetic oligonucleotide
gggaugugaggcguuaugc

SEQ ID NO: 9193 - RNA, 19 nt, Artificial Sequence
  Description of Artificial Sequence: Synthetic oligonucleotide
aacgccucacaucccaagu

SEQ ID NO: 9194 - RNA, 19 nt, Artificial Sequence
  Description of Artificial Sequence: Synthetic oligonucleotide
acuugggaugugaggcguu

SEQ ID NO: 9195 - RNA, 19 nt, Artificial Sequence
  Description of Artificial Sequence: Synthetic oligonucleotide
acgccucacaucccaaguc

SEQ ID NO: 9196 - RNA, 19 nt, Artificial Sequence
  Description of Artificial Sequence: Synthetic oligonucleotide
gacuugggaugugaggcgu

SEQ ID NO: 9197 - RNA, 19 nt, Artificial Sequence
  Description of Artificial Sequence: Synthetic oligonucleotide
cgccucacaucccaagucu

SEQ ID NO: 9198 - RNA, 19 nt, Artificial Sequence
  Description of Artificial Sequence: Synthetic oligonucleotide
agacuugggaugugaggcg

SEQ ID NO: 9199 - RNA, 19 nt, Artificial Sequence
  Description of Artificial Sequence: Synthetic oligonucleotide
ucacaucccaagucuauac

SEQ ID NO: 9200 - RNA, 19 nt, Artificial Sequence
  Description of Artificial Sequence: Synthetic oligonucleotide
guauagacuugggauguga

SEQ ID NO: 9201 - RNA, 19 nt, Artificial Sequence
  Description of Artificial Sequence: Synthetic oligonucleotide
cacaucccaagucuauacc

SEQ ID NO: 9202 - RNA, 19 nt, Artificial Sequence
  Description of Artificial Sequence: Synthetic oligonucleotide
gguauagacuugggaugug

SEQ ID NO: 9203 - RNA, 19 nt, Artificial Sequence
  Description of Artificial Sequence: Synthetic oligonucleotide
acaucccaagucuauaccc

SEQ ID NO: 9204 - RNA, 19 nt, Artificial Sequence
  Description of Artificial Sequence: Synthetic oligonucleotide
ggguauagacuugggaugu

SEQ ID NO: 9205 - RNA, 19 nt, Artificial Sequence
  Description of Artificial Sequence: Synthetic oligonucleotide
caucccaagucuauacccu

SEQ ID NO: 9206 - RNA, 19 nt, Artificial Sequence
  Description of Artificial Sequence: Synthetic oligonucleotide
aggguauagacuugggaug

SEQ ID NO: 9207 - RNA, 19 nt, Artificial Sequence
  Description of Artificial Sequence: Synthetic oligonucleotide
aaugcuguucuuuccuagc

SEQ ID NO: 9208 - RNA, 19 nt, Artificial Sequence
  Description of Artificial Sequence: Synthetic oligonucleotide
gcuaggaaagaacagcauu

SEQ ID NO: 9209 - RNA, 19 nt, Artificial Sequence
  Description of Artificial Sequence: Synthetic oligonucleotide
augcuguucuuuccuagcc

SEQ ID NO: 9210 - RNA, 19 nt, Artificial Sequence
  Description of Artificial Sequence: Synthetic oligonucleotide
ggcuaggaaagaacagcau

SEQ ID NO: 9211 - RNA, 19 nt, Artificial Sequence
  Description of Artificial Sequence: Synthetic oligonucleotide
cuguucuuuccuagccacc

SEQ ID NO: 9212 - RNA, 19 nt, Artificial Sequence
  Description of Artificial Sequence: Synthetic oligonucleotide
gguggcuaggaaagaacag

SEQ ID NO: 9213 - RNA, 19 nt, Artificial Sequence
  Description of Artificial Sequence: Synthetic oligonucleotide
uguucuuuccuagccaccu

SEQ ID NO: 9214 - RNA, 19 nt, Artificial Sequence
  Description of Artificial Sequence: Synthetic oligonucleotide
agguggcuaggaaagaaca

SEQ ID NO: 9215 - RNA, 19 nt, Artificial Sequence
  Description of Artificial Sequence: Synthetic oligonucleotide
gccaagaucaagauguccc

SEQ ID NO: 9216 - RNA, 19 nt, Artificial Sequence
  Description of Artificial Sequence: Synthetic oligonucleotide
gggacaucuugaucuuggc

SEQ ID NO: 9217 - RNA, 19 nt, Artificial Sequence
  Description of Artificial Sequence: Synthetic oligonucleotide
ucuugaucccagccugacu

SEQ ID NO: 9218 - RNA, 19 nt, Artificial Sequence
  Description of Artificial Sequence: Synthetic oligonucleotide
agucaggcugggaucaaga

SEQ ID NO: 9219 - RNA, 19 nt, Artificial Sequence
  Description of Artificial Sequence: Synthetic oligonucleotide
cuugaucccagccugacug

SEQ ID NO: 9220 - RNA, 19 nt, Artificial Sequence
  Description of Artificial Sequence: Synthetic oligonucleotide
cagucaggcugggaucaag

SEQ ID NO: 9221 - RNA, 19 nt, Artificial Sequence
  Description of Artificial Sequence: Synthetic oligonucleotide
uugaucccagccugacugc

SEQ ID NO: 9222 - RNA, 19 nt, Artificial Sequence
  Description of Artificial Sequence: Synthetic oligonucleotide
gcagucaggcugggaucaa

SEQ ID NO: 9223 - RNA, 19 nt, Artificial Sequence
  Description of Artificial Sequence: Synthetic oligonucleotide
ugaucccagccugacugcu

SEQ ID NO: 9224 - RNA, 19 nt, Artificial Sequence
  Description of Artificial Sequence: Synthetic oligonucleotide
agcagucaggcugggauca

SEQ ID NO: 9225 - RNA, 19 nt, Artificial Sequence
  Description of Artificial Sequence: Synthetic oligonucleotide
cugacugcugcuacaucua

SEQ ID NO: 9226 - RNA, 19 nt, Artificial Sequence
  Description of Artificial Sequence: Synthetic oligonucleotide
uagauguagcagcagucag

SEQ ID NO: 9227 - RNA, 19 nt, Artificial Sequence
  Description of Artificial Sequence: Synthetic oligonucleotide
gacugcugcuacaucuaau

SEQ ID NO: 9228 - RNA, 19 nt, Artificial Sequence
  Description of Artificial Sequence: Synthetic oligonucleotide
auuagauguagcagcaguc

SEQ ID NO: 9229 - RNA, 19 nt, Artificial Sequence
  Description of Artificial Sequence: Synthetic oligonucleotide
acugcugcuacaucuaauc

SEQ ID NO: 9230 - RNA, 19 nt, Artificial Sequence
  Description of Artificial Sequence: Synthetic oligonucleotide
gauuagauguagcagcagu

SEQ ID NO: 9231 - RNA, 19 nt, Artificial Sequence
  Description of Artificial Sequence: Synthetic oligonucleotide
cugcugcuacaucuaaucc

SEQ ID NO: 9232 - RNA, 19 nt, Artificial Sequence
  Description of Artificial Sequence: Synthetic oligonucleotide
ggauuagauguagcagcag

SEQ ID NO: 9233 - RNA, 19 nt, Artificial Sequence
  Description of Artificial Sequence: Synthetic oligonucleotide
ugcugcuacaucuaauccc

SEQ ID NO: 9234 - RNA, 19 nt, Artificial Sequence
  Description of Artificial Sequence: Synthetic oligonucleotide
gggauuagauguagcagca

SEQ ID NO: 9235 - RNA, 19 nt, Artificial Sequence
  Description of Artificial Sequence: Synthetic oligonucleotide
ccuaccaaugccuccuguc

SEQ ID NO: 9236 - RNA, 19 nt, Artificial Sequence
  Description of Artificial Sequence: Synthetic oligonucleotide
gacaggaggcauugguagg

SEQ ID NO: 9237 - RNA, 19 nt, Artificial Sequence
  Description of Artificial Sequence: Synthetic oligonucleotide
cuaccaaugccuccugucc

SEQ ID NO: 9238 - RNA, 19 nt, Artificial Sequence
  Description of Artificial Sequence: Synthetic oligonucleotide
ggacaggaggcauugguag

SEQ ID NO: 9239 - RNA, 19 nt, Artificial Sequence
  Description of Artificial Sequence: Synthetic oligonucleotide
ccaaugccuccugucccua

SEQ ID NO: 9240 - RNA, 19 nt, Artificial Sequence
  Description of Artificial Sequence: Synthetic oligonucleotide
uagggacaggaggcauugg

SEQ ID NO: 9241 - RNA, 19 nt, Artificial Sequence
  Description of Artificial Sequence: Synthetic oligonucleotide
caaugccuccugucccuaa

SEQ ID NO: 9242 - RNA, 19 nt, Artificial Sequence
  Description of Artificial Sequence: Synthetic oligonucleotide
uuagggacaggaggcauug

SEQ ID NO: 9243 - RNA, 19 nt, Artificial Sequence
  Description of Artificial Sequence: Synthetic oligonucleotide
aaugccuccugucccuaaa

SEQ ID NO: 9244 - RNA, 19 nt, Artificial Sequence
  Description of Artificial Sequence: Synthetic oligonucleotide
uuuagggacaggaggcauu

SEQ ID NO: 9245 - RNA, 19 nt, Artificial Sequence
  Description of Artificial Sequence: Synthetic oligonucleotide
cccagcauacugaugacag

SEQ ID NO: 9246 - RNA, 19 nt, Artificial Sequence
  Description of Artificial Sequence: Synthetic oligonucleotide
cugucaucaguaugcuggg

SEQ ID NO: 9247 - RNA, 19 nt, Artificial Sequence
  Description of Artificial Sequence: Synthetic oligonucleotide
ccagcauacugaugacagc

SEQ ID NO: 9248 - RNA, 19 nt, Artificial Sequence
  Description of Artificial Sequence: Synthetic oligonucleotide
gcugucaucaguaugcugg

SEQ ID NO: 9249 - RNA, 19 nt, Artificial Sequence
  Description of Artificial Sequence: Synthetic oligonucleotide
cauacugaugacagcccuc

SEQ ID NO: 9250 - RNA, 19 nt, Artificial Sequence
  Description of Artificial Sequence: Synthetic oligonucleotide
gagggcugucaucaguaug

SEQ ID NO: 9251 - RNA, 19 nt, Artificial Sequence
  Description of Artificial Sequence: Synthetic oligonucleotide
auacugaugacagcccucu

SEQ ID NO: 9252 - RNA, 19 nt, Artificial Sequence
  Description of Artificial Sequence: Synthetic oligonucleotide
agagggcugucaucaguau

SEQ ID NO: 9253 - RNA, 19 nt, Artificial Sequence
  Description of Artificial Sequence: Synthetic oligonucleotide
uacugaugacagcccucuc

SEQ ID NO: 9254 - RNA, 19 nt, Artificial Sequence
  Description of Artificial Sequence: Synthetic oligonucleotide
gagagggcugucaucagua

SEQ ID NO: 9255 - RNA, 19 nt, Artificial Sequence
  Description of Artificial Sequence: Synthetic oligonucleotide
acugaugacagcccucucu

SEQ ID NO: 9256 - RNA, 19 nt, Artificial Sequence
  Description of Artificial Sequence: Synthetic oligonucleotide
agagagggcugucaucagu

SEQ ID NO: 9257 - RNA, 19 nt, Artificial Sequence
  Description of Artificial Sequence: Synthetic oligonucleotide
cugaugacagcccucucug

SEQ ID NO: 9258 - RNA, 19 nt, Artificial Sequence
  Description of Artificial Sequence: Synthetic oligonucleotide
cagagagggcugucaucag

SEQ ID NO: 9259 - RNA, 19 nt, Artificial Sequence
  Description of Artificial Sequence: Synthetic oligonucleotide
ugaugacagcccucucuga

SEQ ID NO: 9260 - RNA, 19 nt, Artificial Sequence
  Description of Artificial Sequence: Synthetic oligonucleotide
ucagagagggcugucauca

SEQ ID NO: 9261 - RNA, 19 nt, Artificial Sequence
  Description of Artificial Sequence: Synthetic oligonucleotide
gaugacagcccucucugac

SEQ ID NO: 9262 - RNA, 19 nt, Artificial Sequence
  Description of Artificial Sequence: Synthetic oligonucleotide
gucagagagggcugucauc

SEQ ID NO: 9263 - RNA, 19 nt, Artificial Sequence
  Description of Artificial Sequence: Synthetic oligonucleotide
augacagcccucucugacu

SEQ ID NO: 9264 - RNA, 19 nt, Artificial Sequence
  Description of Artificial Sequence: Synthetic oligonucleotide
agucagagagggcugucau

SEQ ID NO: 9265 - RNA, 19 nt, Artificial Sequence
  Description of Artificial Sequence: Synthetic oligonucleotide
ugacagcccucucugacuu

SEQ ID NO: 9266 - RNA, 19 nt, Artificial Sequence
  Description of Artificial Sequence: Synthetic oligonucleotide
aagucagagagggcuguca

SEQ ID NO: 9267 - RNA, 19 nt, Artificial Sequence
  Description of Artificial Sequence: Synthetic oligonucleotide
gacagcccucucugacuuu

SEQ ID NO: 9268 - RNA, 19 nt, Artificial Sequence
  Description of Artificial Sequence: Synthetic oligonucleotide
aaagucagagagggcuguc

SEQ ID NO: 9269 - RNA, 19 nt, Artificial Sequence
  Description of Artificial Sequence: Synthetic oligonucleotide
acagcccucucugacuuua

SEQ ID NO: 9270 - RNA, 19 nt, Artificial Sequence
  Description of Artificial Sequence: Synthetic oligonucleotide
uaaagucagagagggcugu

SEQ ID NO: 9271 - RNA, 19 nt, Artificial Sequence
  Description of Artificial Sequence: Synthetic oligonucleotide
cagcccucucugacuuuac

SEQ ID NO: 9272 - RNA, 19 nt, Artificial Sequence
  Description of Artificial Sequence: Synthetic oligonucleotide
guaaagucagagagggcug

SEQ ID NO: 9273 - RNA, 19 nt, Artificial Sequence
  Description of Artificial Sequence: Synthetic oligonucleotide
agcccucucugacuuuacc

SEQ ID NO: 9274 - RNA, 19 nt, Artificial Sequence
  Description of Artificial Sequence: Synthetic oligonucleotide
gguaaagucagagagggcu

SEQ ID NO: 9275 - RNA, 19 nt, Artificial Sequence
  Description of Artificial Sequence: Synthetic oligonucleotide
gcccucucugacuuuaccu

SEQ ID NO: 9276 - RNA, 19 nt, Artificial Sequence
  Description of Artificial Sequence: Synthetic oligonucleotide
agguaaagucagagagggc

SEQ ID NO: 9277 - RNA, 19 nt, Artificial Sequence
  Description of Artificial Sequence: Synthetic oligonucleotide
cccucucugacuuuaccuu

SEQ ID NO: 9278 - RNA, 19 nt, Artificial Sequence
  Description of Artificial Sequence: Synthetic oligonucleotide
aagguaaagucagagaggg

SEQ ID NO: 9279 - RNA, 19 nt, Artificial Sequence
  Description of Artificial Sequence: Synthetic oligonucleotide
ccucucugacuuuaccuug

SEQ ID NO: 9280 - RNA, 19 nt, Artificial Sequence
  Description of Artificial Sequence: Synthetic oligonucleotide
caagguaaagucagagagg

SEQ ID NO: 9281 - RNA, 19 nt, Artificial Sequence
  Description of Artificial Sequence: Synthetic oligonucleotide
cucucugacuuuaccuuga

SEQ ID NO: 9282 - RNA, 19 nt, Artificial Sequence
  Description of Artificial Sequence: Synthetic oligonucleotide
ucaagguaaagucagagag

SEQ ID NO: 9283 - RNA, 19 nt, Artificial Sequence
  Description of Artificial Sequence: Synthetic oligonucleotide
agaucugucuucauacccu

SEQ ID NO: 9284 - RNA, 19 nt, Artificial Sequence
  Description of Artificial Sequence: Synthetic oligonucleotide
aggguaugaagacagaucu

SEQ ID NO: 9285 - RNA, 19 nt, Artificial Sequence
  Description of Artificial Sequence: Synthetic oligonucleotide
gaucugucuucauacccuu

SEQ ID NO: 9286 - RNA, 19 nt, Artificial Sequence
  Description of Artificial Sequence: Synthetic oligonucleotide
aaggguaugaagacagauc

SEQ ID NO: 9287 - RNA, 19 nt, Artificial Sequence
  Description of Artificial Sequence: Synthetic oligonucleotide
cugucuucauacccuuccc

SEQ ID NO: 9288 - RNA, 19 nt, Artificial Sequence
  Description of Artificial Sequence: Synthetic oligonucleotide
gggaaggguaugaagacag

SEQ ID NO: 9289 - RNA, 19 nt, Artificial Sequence
  Description of Artificial Sequence: Synthetic oligonucleotide
uauuuaccacuaagacuuc

SEQ ID NO: 9290 - RNA, 19 nt, Artificial Sequence
  Description of Artificial Sequence: Synthetic oligonucleotide
gaagucuuagugguaaaua

SEQ ID NO: 9291 - RNA, 19 nt, Artificial Sequence
  Description of Artificial Sequence: Synthetic oligonucleotide
auuuaccacuaagacuucu

SEQ ID NO: 9292 - RNA, 19 nt, Artificial Sequence
  Description of Artificial Sequence: Synthetic oligonucleotide
agaagucuuagugguaaau

SEQ ID NO: 9293 - RNA, 19 nt, Artificial Sequence
  Description of Artificial Sequence: Synthetic oligonucleotide
uuuaccacuaagacuucug

SEQ ID NO: 9294 - RNA, 19 nt, Artificial Sequence
  Description of Artificial Sequence: Synthetic oligonucleotide
cagaagucuuagugguaaa

SEQ ID NO: 9295 - RNA, 19 nt, Artificial Sequence
  Description of Artificial Sequence: Synthetic oligonucleotide
uuaccacuaagacuucuga

SEQ ID NO: 9296 - RNA, 19 nt, Artificial Sequence
  Description of Artificial Sequence: Synthetic oligonucleotide
ucagaagucuuagugguaa

SEQ ID NO: 9297 - RNA, 19 nt, Artificial Sequence
  Description of Artificial Sequence: Synthetic oligonucleotide
uaccacuaagacuucugac

SEQ ID NO: 9298 - RNA, 19 nt, Artificial Sequence
  Description of Artificial Sequence: Synthetic oligonucleotide
gucagaagucuuaguggua

SEQ ID NO: 9299 - RNA, 19 nt, Artificial Sequence
  Description of Artificial Sequence: Synthetic oligonucleotide
accacuaagacuucugacu

SEQ ID NO: 9300 - RNA, 19 nt, Artificial Sequence
  Description of Artificial Sequence: Synthetic oligonucleotide
agucagaagucuuaguggu

SEQ ID NO: 9301 - RNA, 19 nt, Artificial Sequence
  Description of Artificial Sequence: Synthetic oligonucleotide
acuucugacuccaauuuaa

SEQ ID NO: 9302 - RNA, 19 nt, Artificial Sequence
  Description of Artificial Sequence: Synthetic oligonucleotide
uuaaauuggagucagaagu

SEQ ID NO: 9303 - RNA, 19 nt, Artificial Sequence
  Description of Artificial Sequence: Synthetic oligonucleotide
cuucugacuccaauuuaaa

SEQ ID NO: 9304 - RNA, 19 nt, Artificial Sequence
  Description of Artificial Sequence: Synthetic oligonucleotide
uuuaaauuggagucagaag

SEQ ID NO: 9305 - RNA, 19 nt, Artificial Sequence
  Description of Artificial Sequence: Synthetic oligonucleotide
acacccagucccagaucca

SEQ ID NO: 9306 - RNA, 19 nt, Artificial Sequence
  Description of Artificial Sequence: Synthetic oligonucleotide
uggaucugggacugggugu

SEQ ID NO: 9307 - RNA, 19 nt, Artificial Sequence
  Description of Artificial Sequence: Synthetic oligonucleotide
cacccagucccagauccaa

SEQ ID NO: 9308 - RNA, 19 nt, Artificial Sequence
  Description of Artificial Sequence: Synthetic oligonucleotide
uuggaucugggacugggug

SEQ ID NO: 9309 - RNA, 19 nt, Artificial Sequence
  Description of Artificial Sequence: Synthetic oligonucleotide
acccagucccagauccaaa

SEQ ID NO: 9310 - RNA, 19 nt, Artificial Sequence
  Description of Artificial Sequence: Synthetic oligonucleotide
uuuggaucugggacugggu

SEQ ID NO: 9311 - RNA, 19 nt, Artificial Sequence
  Description of Artificial Sequence: Synthetic oligonucleotide
uuccagcucagcagugucu

SEQ ID NO: 9312 - RNA, 19 nt, Artificial Sequence
  Description of Artificial Sequence: Synthetic oligonucleotide
agacacugcugagcuggaa

SEQ ID NO: 9313 - RNA, 19 nt, Artificial Sequence
  Description of Artificial Sequence: Synthetic oligonucleotide
uccagcucagcagugucuc

SEQ ID NO: 9314 - RNA, 19 nt, Artificial Sequence
  Description of Artificial Sequence: Synthetic oligonucleotide
gagacacugcugagcugga

SEQ ID NO: 9315 - RNA, 19 nt, Artificial Sequence
  Description of Artificial Sequence: Synthetic oligonucleotide
ccagcucagcagugucucg

SEQ ID NO: 9316 - RNA, 19 nt, Artificial Sequence
  Description of Artificial Sequence: Synthetic oligonucleotide
cgagacacugcugagcugg

SEQ ID NO: 9317 - RNA, 19 nt, Artificial Sequence
  Description of Artificial Sequence: Synthetic oligonucleotide
cagcucagcagugucucgu

SEQ ID NO: 9318 - RNA, 19 nt, Artificial Sequence
  Description of Artificial Sequence: Synthetic oligonucleotide
acgagacacugcugagcug

SEQ ID NO: 9319 - RNA, 19 nt, Artificial Sequence
  Description of Artificial Sequence: Synthetic oligonucleotide
agcucagcagugucucguu

SEQ ID NO: 9320 - RNA, 19 nt, Artificial Sequence
  Description of Artificial Sequence: Synthetic oligonucleotide
aacgagacacugcugagcu

SEQ ID NO: 9321 - RNA, 19 nt, Artificial Sequence
  Description of Artificial Sequence: Synthetic oligonucleotide
gcucagcagugucucguuc

SEQ ID NO: 9322 - RNA, 19 nt, Artificial Sequence
  Description of Artificial Sequence: Synthetic oligonucleotide
gaacgagacacugcugagc

SEQ ID NO: 9323 - RNA, 19 nt, Artificial Sequence
  Description of Artificial Sequence: Synthetic oligonucleotide
cucagcagugucucguucc

SEQ ID NO: 9324 - RNA, 19 nt, Artificial Sequence
  Description of Artificial Sequence: Synthetic oligonucleotide
ggaacgagacacugcugag

SEQ ID NO: 9325 - RNA, 19 nt, Artificial Sequence
  Description of Artificial Sequence: Synthetic oligonucleotide
guagcagaccgacauccuu

SEQ ID NO: 9326 - RNA, 19 nt, Artificial Sequence
  Description of Artificial Sequence: Synthetic oligonucleotide
aaggaugucggucugcuac

SEQ ID NO: 9327 - RNA, 19 nt, Artificial Sequence
  Description of Artificial Sequence: Synthetic oligonucleotide
uagcagaccgacauccuuc

SEQ ID NO: 9328 - RNA, 19 nt, Artificial Sequence
  Description of Artificial Sequence: Synthetic oligonucleotide
gaaggaugucggucugcua

SEQ ID NO: 9329 - RNA, 19 nt, Artificial Sequence
  Description of Artificial Sequence: Synthetic oligonucleotide
agcagaccgacauccuucu

SEQ ID NO: 9330 - RNA, 19 nt, Artificial Sequence
  Description of Artificial Sequence: Synthetic oligonucleotide
agaaggaugucggucugcu

SEQ ID NO: 9331 - RNA, 19 nt, Artificial Sequence
  Description of Artificial Sequence: Synthetic oligonucleotide
agaccgacauccuucuggg

SEQ ID NO: 9332 - RNA, 19 nt, Artificial Sequence
  Description of Artificial Sequence: Synthetic oligonucleotide
cccagaaggaugucggucu

SEQ ID NO: 9333 - RNA, 19 nt, Artificial Sequence
  Description of Artificial Sequence: Synthetic oligonucleotide
gaccgacauccuucugggc

SEQ ID NO: 9334 - RNA, 19 nt, Artificial Sequence
  Description of Artificial Sequence: Synthetic oligonucleotide
gcccagaaggaugucgguc

SEQ ID NO: 9335 - RNA, 19 nt, Artificial Sequence
  Description of Artificial Sequence: Synthetic oligonucleotide
ccgacauccuucugggccu

SEQ ID NO: 9336 - RNA, 19 nt, Artificial Sequence
  Description of Artificial Sequence: Synthetic oligonucleotide
aggcccagaaggaugucgg

SEQ ID NO: 9337 - RNA, 19 nt, Artificial Sequence
  Description of Artificial Sequence: Synthetic oligonucleotide
cgacauccuucugggccua

SEQ ID NO: 9338 - RNA, 19 nt, Artificial Sequence
  Description of Artificial Sequence: Synthetic oligonucleotide
uaggcccagaaggaugucg

SEQ ID NO: 9339 - RNA, 19 nt, Artificial Sequence
  Description of Artificial Sequence: Synthetic oligonucleotide
gacauccuucugggccuac

SEQ ID NO: 9340 - RNA, 19 nt, Artificial Sequence
  Description of Artificial Sequence: Synthetic oligonucleotide
guaggcccagaaggauguc

SEQ ID NO: 9341 - RNA, 19 nt, Artificial Sequence
  Description of Artificial Sequence: Synthetic oligonucleotide
cuucugggccuacaggugg

SEQ ID NO: 9342 - RNA, 19 nt, Artificial Sequence
  Description of Artificial Sequence: Synthetic oligonucleotide
ccaccuguaggcccagaag

SEQ ID NO: 9343 - RNA, 19 nt, Artificial Sequence
  Description of Artificial Sequence: Synthetic oligonucleotide
uucugggccuacagguggg

SEQ ID NO: 9344 - RNA, 19 nt, Artificial Sequence
  Description of Artificial Sequence: Synthetic oligonucleotide
cccaccuguaggcccagaa

SEQ ID NO: 9345 - RNA, 19 nt, Artificial Sequence
  Description of Artificial Sequence: Synthetic oligonucleotide
ucugggccuacaggugggu

SEQ ID NO: 9346 - RNA, 19 nt, Artificial Sequence
  Description of Artificial Sequence: Synthetic oligonucleotide
acccaccuguaggcccaga

SEQ ID NO: 9347 - RNA, 19 nt, Artificial Sequence
  Description of Artificial Sequence: Synthetic oligonucleotide
ggccuacagguggguggaa

SEQ ID NO: 9348 - RNA, 19 nt, Artificial Sequence
  Description of Artificial Sequence: Synthetic oligonucleotide
uuccacccaccuguaggcc

SEQ ID NO: 9349 - RNA, 19 nt, Artificial Sequence
  Description of Artificial Sequence: Synthetic oligonucleotide
ccuacagguggguggaagg

SEQ ID NO: 9350 - RNA, 19 nt, Artificial Sequence
  Description of Artificial Sequence: Synthetic oligonucleotide
ccuuccacccaccuguagg

SEQ ID NO: 9351 - RNA, 19 nt, Artificial Sequence
  Description of Artificial Sequence: Synthetic oligonucleotide
cuacagguggguggaaggc

SEQ ID NO: 9352 - RNA, 19 nt, Artificial Sequence
  Description of Artificial Sequence: Synthetic oligonucleotide
gccuuccacccaccuguag

SEQ ID NO: 9353 - RNA, 19 nt, Artificial Sequence
  Description of Artificial Sequence: Synthetic oligonucleotide
uacagguggguggaaggcg

SEQ ID NO: 9354 - RNA, 19 nt, Artificial Sequence
  Description of Artificial Sequence: Synthetic oligonucleotide
cgccuuccacccaccugua

SEQ ID NO: 9355 - RNA, 19 nt, Artificial Sequence
  Description of Artificial Sequence: Synthetic oligonucleotide
acuucccugcagccugccu

SEQ ID NO: 9356 - RNA, 19 nt, Artificial Sequence
  Description of Artificial Sequence: Synthetic oligonucleotide
aggcaggcugcagggaagu

SEQ ID NO: 9357 - RNA, 19 nt, Artificial Sequence
  Description of Artificial Sequence: Synthetic oligonucleotide
ccugcagccugccucuuuu

SEQ ID NO: 9358 - RNA, 19 nt, Artificial Sequence
  Description of Artificial Sequence: Synthetic oligonucleotide
aaaagaggcaggcugcagg

SEQ ID NO: 9359 - RNA, 19 nt, Artificial Sequence
  Description of Artificial Sequence: Synthetic oligonucleotide
cugcagccugccucuuuuc

SEQ ID NO: 9360 - RNA, 19 nt, Artificial Sequence
  Description of Artificial Sequence: Synthetic oligonucleotide
gaaaagaggcaggcugcag

SEQ ID NO: 9361 - RNA, 19 nt, Artificial Sequence
  Description of Artificial Sequence: Synthetic oligonucleotide
gcagccugccucuuuucug

SEQ ID NO: 9362 - RNA, 19 nt, Artificial Sequence
  Description of Artificial Sequence: Synthetic oligonucleotide
cagaaaagaggcaggcugc

SEQ ID NO: 9363 - RNA, 19 nt, Artificial Sequence
  Description of Artificial Sequence: Synthetic oligonucleotide
cagccugccucuuuucugc

SEQ ID NO: 9364 - RNA, 19 nt, Artificial Sequence
  Description of Artificial Sequence: Synthetic oligonucleotide
gcagaaaagaggcaggcug

SEQ ID NO: 9365 - RNA, 19 nt, Artificial Sequence
  Description of Artificial Sequence: Synthetic oligonucleotide
agccugccucuuuucugcc

SEQ ID NO: 9366 - RNA, 19 nt, Artificial Sequence
  Description of Artificial Sequence: Synthetic oligonucleotide
ggcagaaaagaggcaggcu

SEQ ID NO: 9367 - RNA, 19 nt, Artificial Sequence
  Description of Artificial Sequence: Synthetic oligonucleotide
gccucuuuucugccuggga

SEQ ID NO: 9368 - RNA, 19 nt, Artificial Sequence
  Description of Artificial Sequence: Synthetic oligonucleotide
ucccaggcagaaaagaggc

SEQ ID NO: 9369 - RNA, 19 nt, Artificial Sequence
  Description of Artificial Sequence: Synthetic oligonucleotide
cuuuucugccugggagucc

SEQ ID NO: 9370 - RNA, 19 nt, Artificial Sequence
  Description of Artificial Sequence: Synthetic oligonucleotide
ggacucccaggcagaaaag

SEQ ID NO: 9371 - RNA, 19 nt, Artificial Sequence
  Description of Artificial Sequence: Synthetic oligonucleotide
uuuucugccugggaguccu

SEQ ID NO: 9372 - RNA, 19 nt, Artificial Sequence
  Description of Artificial Sequence: Synthetic oligonucleotide
aggacucccaggcagaaaa

SEQ ID NO: 9373 - RNA, 19 nt, Artificial Sequence
  Description of Artificial Sequence: Synthetic oligonucleotide
uucugccugggaguccuga

SEQ ID NO: 9374 - RNA, 19 nt, Artificial Sequence
  Description of Artificial Sequence: Synthetic oligonucleotide
ucaggacucccaggcagaa

SEQ ID NO: 9375 - RNA, 19 nt, Artificial Sequence
  Description of Artificial Sequence: Synthetic oligonucleotide
ucugccugggaguccugac

SEQ ID NO: 9376 - RNA, 19 nt, Artificial Sequence
  Description of Artificial Sequence: Synthetic oligonucleotide
gucaggacucccaggcaga

SEQ ID NO: 9377 - RNA, 19 nt, Artificial Sequence
  Description of Artificial Sequence: Synthetic oligonucleotide
ugccugggaguccugacuu

SEQ ID NO: 9378 - RNA, 19 nt, Artificial Sequence
  Description of Artificial Sequence: Synthetic oligonucleotide
aagucaggacucccaggca

SEQ ID NO: 9379 - RNA, 19 nt, Artificial Sequence
  Description of Artificial Sequence: Synthetic oligonucleotide
gccugggaguccugacuuc

SEQ ID NO: 9380 - RNA, 19 nt, Artificial Sequence
  Description of Artificial Sequence: Synthetic oligonucleotide
gaagucaggacucccaggc

SEQ ID NO: 9381 - RNA, 19 nt, Artificial Sequence
  Description of Artificial Sequence: Synthetic oligonucleotide
cugggaguccugacuucca

SEQ ID NO: 9382 - RNA, 19 nt, Artificial Sequence
  Description of Artificial Sequence: Synthetic oligonucleotide
uggaagucaggacucccag

SEQ ID NO: 9383 - RNA, 19 nt, Artificial Sequence
  Description of Artificial Sequence: Synthetic oligonucleotide
ugggaguccugacuuccac

SEQ ID NO: 9384 - RNA, 19 nt, Artificial Sequence
  Description of Artificial Sequence: Synthetic oligonucleotide
guggaagucaggacuccca

SEQ ID NO: 9385 - RNA, 19 nt, Artificial Sequence
  Description of Artificial Sequence: Synthetic oligonucleotide
gggaguccugacuuccacg

SEQ ID NO: 9386 - RNA, 19 nt, Artificial Sequence
  Description of Artificial Sequence: Synthetic oligonucleotide
cguggaagucaggacuccc

SEQ ID NO: 9387 - RNA, 19 nt, Artificial Sequence
  Description of Artificial Sequence: Synthetic oligonucleotide
ggaguccugacuuccacga

SEQ ID NO: 9388 - RNA, 19 nt, Artificial Sequence
  Description of Artificial Sequence: Synthetic oligonucleotide
ucguggaagucaggacucc

SEQ ID NO: 9389 - RNA, 19 nt, Artificial Sequence
  Description of Artificial Sequence: Synthetic oligonucleotide
gaguccugacuuccacgag

SEQ ID NO: 9390 - RNA, 19 nt, Artificial Sequence
  Description of Artificial Sequence: Synthetic oligonucleotide
cucguggaagucaggacuc

SEQ ID NO: 9391 - RNA, 19 nt, Artificial Sequence
  Description of Artificial Sequence: Synthetic oligonucleotide
aguccugacuuccacgagg

SEQ ID NO: 9392 - RNA, 19 nt, Artificial Sequence
  Description of Artificial Sequence: Synthetic oligonucleotide
ccucguggaagucaggacu

SEQ ID NO: 9393 - RNA, 19 nt, Artificial Sequence
  Description of Artificial Sequence: Synthetic oligonucleotide
ccugacuuccacgaggacc

SEQ ID NO: 9394 - RNA, 19 nt, Artificial Sequence
  Description of Artificial Sequence: Synthetic oligonucleotide
gguccucguggaagucagg

SEQ ID NO: 9395 - RNA, 19 nt, Artificial Sequence
  Description of Artificial Sequence: Synthetic oligonucleotide
cugacuuccacgaggaccc

SEQ ID NO: 9396 - RNA, 19 nt, Artificial Sequence
  Description of Artificial Sequence: Synthetic oligonucleotide
ggguccucguggaagucag

SEQ ID NO: 9397 - RNA, 19 nt, Artificial Sequence
  Description of Artificial Sequence: Synthetic oligonucleotide
ugacuuccacgaggaccca

SEQ ID NO: 9398 - RNA, 19 nt, Artificial Sequence
  Description of Artificial Sequence: Synthetic oligonucleotide
uggguccucguggaaguca

SEQ ID NO: 9399 - RNA, 19 nt, Artificial Sequence
  Description of Artificial Sequence: Synthetic oligonucleotide
gacuuccacgaggacccag

SEQ ID NO: 9400 - RNA, 19 nt, Artificial Sequence
  Description of Artificial Sequence: Synthetic oligonucleotide
cuggguccucguggaaguc

SEQ ID NO: 9401 - RNA, 19 nt, Artificial Sequence
  Description of Artificial Sequence: Synthetic oligonucleotide
acuuccacgaggacccaga

SEQ ID NO: 9402 - RNA, 19 nt, Artificial Sequence
  Description of Artificial Sequence: Synthetic oligonucleotide
ucuggguccucguggaagu

SEQ ID NO: 9403 - RNA, 19 nt, Artificial Sequence
  Description of Artificial Sequence: Synthetic oligonucleotide
cuuccacgaggacccagac

SEQ ID NO: 9404 - RNA, 19 nt, Artificial Sequence
  Description of Artificial Sequence: Synthetic oligonucleotide
gucuggguccucguggaag

SEQ ID NO: 9405 - RNA, 19 nt, Artificial Sequence
  Description of Artificial Sequence: Synthetic oligonucleotide
uuccacgaggacccagacc

SEQ ID NO: 9406 - RNA, 19 nt, Artificial Sequence
  Description of Artificial Sequence: Synthetic oligonucleotide
ggucuggguccucguggaa

SEQ ID NO: 9407 - RNA, 19 nt, Artificial Sequence
  Description of Artificial Sequence: Synthetic oligonucleotide
cccugcucccagucaguug

SEQ ID NO: 9408 - RNA, 19 nt, Artificial Sequence
  Description of Artificial Sequence: Synthetic oligonucleotide
caacugacugggagcaggg

SEQ ID NO: 9409 - RNA, 19 nt, Artificial Sequence
  Description of Artificial Sequence: Synthetic oligonucleotide
ccugcucccagucaguuga

SEQ ID NO: 9410 - RNA, 19 nt, Artificial Sequence
  Description of Artificial Sequence: Synthetic oligonucleotide
ucaacugacugggagcagg

SEQ ID NO: 9411 - RNA, 19 nt, Artificial Sequence
  Description of Artificial Sequence: Synthetic oligonucleotide
cugcucccagucaguugac

SEQ ID NO: 9412 - RNA, 19 nt, Artificial Sequence
  Description of Artificial Sequence: Synthetic oligonucleotide
gucaacugacugggagcag

SEQ ID NO: 9413 - RNA, 19 nt, Artificial Sequence
  Description of Artificial Sequence: Synthetic oligonucleotide
ugcucccagucaguugacc

SEQ ID NO: 9414 - RNA, 19 nt, Artificial Sequence
  Description of Artificial Sequence: Synthetic oligonucleotide
ggucaacugacugggagca

SEQ ID NO: 9415 - RNA, 19 nt, Artificial Sequence
  Description of Artificial Sequence: Synthetic oligonucleotide
cccagucaguugaccugcc

SEQ ID NO: 9416 - RNA, 19 nt, Artificial Sequence
  Description of Artificial Sequence: Synthetic oligonucleotide
ggcaggucaacugacuggg

SEQ ID NO: 9417 - RNA, 19 nt, Artificial Sequence
  Description of Artificial Sequence: Synthetic oligonucleotide
ccagucaguugaccugccc

SEQ ID NO: 9418 - RNA, 19 nt, Artificial Sequence
  Description of Artificial Sequence: Synthetic oligonucleotide
gggcaggucaacugacugg

SEQ ID NO: 9419 - RNA, 19 nt, Artificial Sequence
  Description of Artificial Sequence: Synthetic oligonucleotide
gccuccuucccagagcuca

SEQ ID NO: 9420 - RNA, 19 nt, Artificial Sequence
  Description of Artificial Sequence: Synthetic oligonucleotide
ugagcucugggaaggaggc

SEQ ID NO: 9421 - RNA, 19 nt, Artificial Sequence
  Description of Artificial Sequence: Synthetic oligonucleotide
ccuccuucccagagcucag

SEQ ID NO: 9422 - RNA, 19 nt, Artificial Sequence
  Description of Artificial Sequence: Synthetic oligonucleotide
cugagcucugggaaggagg

SEQ ID NO: 9423 - RNA, 19 nt, Artificial Sequence
  Description of Artificial Sequence: Synthetic oligonucleotide
cuccuucccagagcucagu

SEQ ID NO: 9424 - RNA, 19 nt, Artificial Sequence
  Description of Artificial Sequence: Synthetic oligonucleotide
acugagcucugggaaggag

SEQ ID NO: 9425 - RNA, 19 nt, Artificial Sequence
  Description of Artificial Sequence: Synthetic oligonucleotide
uccuucccagagcucagug

SEQ ID NO: 9426 - RNA, 19 nt, Artificial Sequence
  Description of Artificial Sequence: Synthetic oligonucleotide
cacugagcucugggaagga

SEQ ID NO: 9427 - RNA, 19 nt, Artificial Sequence
  Description of Artificial Sequence: Synthetic oligonucleotide
ccuucccagagcucagugg

SEQ ID NO: 9428 - RNA, 19 nt, Artificial Sequence
  Description of Artificial Sequence: Synthetic oligonucleotide
ccacugagcucugggaagg

SEQ ID NO: 9429 - RNA, 19 nt, Artificial Sequence
  Description of Artificial Sequence: Synthetic oligonucleotide
uucccagagcucaguggua

SEQ ID NO: 9430 - RNA, 19 nt, Artificial Sequence
  Description of Artificial Sequence: Synthetic oligonucleotide
uaccacugagcucugggaa

SEQ ID NO: 9431 - RNA, 19 nt, Artificial Sequence
  Description of Artificial Sequence: Synthetic oligonucleotide
ucccagagcucagugguaa

SEQ ID NO: 9432 - RNA, 19 nt, Artificial Sequence
  Description of Artificial Sequence: Synthetic oligonucleotide
uuaccacugagcucuggga

SEQ ID NO: 9433 - RNA, 19 nt, Artificial Sequence
  Description of Artificial Sequence: Synthetic oligonucleotide
caggcugucacuaucucua

SEQ ID NO: 9434 - RNA, 19 nt, Artificial Sequence
  Description of Artificial Sequence: Synthetic oligonucleotide
uagagauagugacagccug

SEQ ID NO: 9435 - RNA, 19 nt, Artificial Sequence
  Description of Artificial Sequence: Synthetic oligonucleotide
aggcugucacuaucucuac

SEQ ID NO: 9436 - RNA, 19 nt, Artificial Sequence
  Description of Artificial Sequence: Synthetic oligonucleotide
guagagauagugacagccu

SEQ ID NO: 9437 - RNA, 19 nt, Artificial Sequence
  Description of Artificial Sequence: Synthetic oligonucleotide
ucucuaccaccacuccucu

SEQ ID NO: 9438 - RNA, 19 nt, Artificial Sequence
  Description of Artificial Sequence: Synthetic oligonucleotide
agaggaguggugguagaga

SEQ ID NO: 9439 - RNA, 19 nt, Artificial Sequence
  Description of Artificial Sequence: Synthetic oligonucleotide
ccaccacuccucuagucug

SEQ ID NO: 9440 - RNA, 19 nt, Artificial Sequence
  Description of Artificial Sequence: Synthetic oligonucleotide
cagacuagaggaguggugg

SEQ ID NO: 9441 - RNA, 19 nt, Artificial Sequence
  Description of Artificial Sequence: Synthetic oligonucleotide
caccacuccucuagucugg

SEQ ID NO: 9442 - RNA, 19 nt, Artificial Sequence
  Description of Artificial Sequence: Synthetic oligonucleotide
ccagacuagaggaguggug

SEQ ID NO: 9443 - RNA, 19 nt, Artificial Sequence
  Description of Artificial Sequence: Synthetic oligonucleotide
accacuccucuagucuggc

SEQ ID NO: 9444 - RNA, 19 nt, Artificial Sequence
  Description of Artificial Sequence: Synthetic oligonucleotide
gccagacuagaggaguggu

SEQ ID NO: 9445 - RNA, 19 nt, Artificial Sequence
  Description of Artificial Sequence: Synthetic oligonucleotide
ccacuccucuagucuggcc

SEQ ID NO: 9446 - RNA, 19 nt, Artificial Sequence
  Description of Artificial Sequence: Synthetic oligonucleotide
ggccagacuagaggagugg

SEQ ID NO: 9447 - RNA, 19 nt, Artificial Sequence
  Description of Artificial Sequence: Synthetic oligonucleotide
cacuccucuagucuggccc

SEQ ID NO: 9448 - RNA, 19 nt, Artificial Sequence
  Description of Artificial Sequence: Synthetic oligonucleotide
gggccagacuagaggagug

SEQ ID NO: 9449 - RNA, 19 nt, Artificial Sequence
  Description of Artificial Sequence: Synthetic oligonucleotide
auucuagcacaucugggca

SEQ ID NO: 9450 - RNA, 19 nt, Artificial Sequence
  Description of Artificial Sequence: Synthetic oligonucleotide
ugcccagaugugcuagaau

SEQ ID NO: 9451 - RNA, 19 nt, Artificial Sequence
  Description of Artificial Sequence: Synthetic oligonucleotide
uucuagcacaucugggcaa

SEQ ID NO: 9452 - RNA, 19 nt, Artificial Sequence
  Description of Artificial Sequence: Synthetic oligonucleotide
uugcccagaugugcuagaa

SEQ ID NO: 9453 - RNA, 19 nt, Artificial Sequence
  Description of Artificial Sequence: Synthetic oligonucleotide
ucuagcacaucugggcaaa

SEQ ID NO: 9454 - RNA, 19 nt, Artificial Sequence
  Description of Artificial Sequence: Synthetic oligonucleotide
uuugcccagaugugcuaga

SEQ ID NO: 9455 - RNA, 19 nt, Artificial Sequence
  Description of Artificial Sequence: Synthetic oligonucleotide
cuagcacaucugggcaaaa

SEQ ID NO: 9456 - RNA, 19 nt, Artificial Sequence
  Description of Artificial Sequence: Synthetic oligonucleotide
uuuugcccagaugugcuag

SEQ ID NO: 9457 - RNA, 19 nt, Artificial Sequence
  Description of Artificial Sequence: Synthetic oligonucleotide
ggguguaaagggacgugca

SEQ ID NO: 9458 - RNA, 19 nt, Artificial Sequence
  Description of Artificial Sequence: Synthetic oligonucleotide
ugcacgucccuuuacaccc

SEQ ID NO: 9459 - RNA, 19 nt, Artificial Sequence
  Description of Artificial Sequence: Synthetic oligonucleotide
gguguaaagggacgugcac

SEQ ID NO: 9460 - RNA, 19 nt, Artificial Sequence
  Description of Artificial Sequence: Synthetic oligonucleotide
gugcacgucccuuuacacc

SEQ ID NO: 9461 - RNA, 19 nt, Artificial Sequence
  Description of Artificial Sequence: Synthetic oligonucleotide
guguaaagggacgugcaca

SEQ ID NO: 9462 - RNA, 19 nt, Artificial Sequence
  Description of Artificial Sequence: Synthetic oligonucleotide
ugugcacgucccuuuacac

SEQ ID NO: 9463 - RNA, 19 nt, Artificial Sequence
  Description of Artificial Sequence: Synthetic oligonucleotide
uguaaagggacgugcacag

SEQ ID NO: 9464 - RNA, 19 nt, Artificial Sequence
  Description of Artificial Sequence: Synthetic oligonucleotide
cugugcacgucccuuuaca

SEQ ID NO: 9465 - RNA, 19 nt, Artificial Sequence
  Description of Artificial Sequence: Synthetic oligonucleotide
guaaagggacgugcacaga

SEQ ID NO: 9466 - RNA, 19 nt, Artificial Sequence
  Description of Artificial Sequence: Synthetic oligonucleotide
ucugugcacgucccuuuac

SEQ ID NO: 9467 - RNA, 19 nt, Artificial Sequence
  Description of Artificial Sequence: Synthetic oligonucleotide
uaaagggacgugcacagau

SEQ ID NO: 9468 - RNA, 19 nt, Artificial Sequence
  Description of Artificial Sequence: Synthetic oligonucleotide
aucugugcacgucccuuua

SEQ ID NO: 9469 - RNA, 19 nt, Artificial Sequence
  Description of Artificial Sequence: Synthetic oligonucleotide
aaagggacgugcacagauc

SEQ ID NO: 9470 - RNA, 19 nt, Artificial Sequence
  Description of Artificial Sequence: Synthetic oligonucleotide
gaucugugcacgucccuuu

SEQ ID NO: 9471 - RNA, 19 nt, Artificial Sequence
  Description of Artificial Sequence: Synthetic oligonucleotide
aagggacgugcacagaucu

SEQ ID NO: 9472 - RNA, 19 nt, Artificial Sequence
  Description of Artificial Sequence: Synthetic oligonucleotide
agaucugugcacgucccuu

SEQ ID NO: 9473 - RNA, 19 nt, Artificial Sequence
  Description of Artificial Sequence: Synthetic oligonucleotide
agggacgugcacagaucua

SEQ ID NO: 9474 - RNA, 19 nt, Artificial Sequence
  Description of Artificial Sequence: Synthetic oligonucleotide
uagaucugugcacgucccu

SEQ ID NO: 9475 - RNA, 19 nt, Artificial Sequence
  Description of Artificial Sequence: Synthetic oligonucleotide
cgugcacagaucuacuuac

SEQ ID NO: 9476 - RNA, 19 nt, Artificial Sequence
  Description of Artificial Sequence: Synthetic oligonucleotide
guaaguagaucugugcacg

SEQ ID NO: 9477 - RNA, 19 nt, Artificial Sequence
  Description of Artificial Sequence: Synthetic oligonucleotide
gugcacagaucuacuuacc

SEQ ID NO: 9478 - RNA, 19 nt, Artificial Sequence
  Description of Artificial Sequence: Synthetic oligonucleotide
gguaaguagaucugugcac

SEQ ID NO: 9479 - RNA, 19 nt, Artificial Sequence
  Description of Artificial Sequence: Synthetic oligonucleotide
ugcacagaucuacuuacca

SEQ ID NO: 9480 - RNA, 19 nt, Artificial Sequence
  Description of Artificial Sequence: Synthetic oligonucleotide
ugguaaguagaucugugca

SEQ ID NO: 9481 - RNA, 19 nt, Artificial Sequence
  Description of Artificial Sequence: Synthetic oligonucleotide
gcacagaucuacuuaccaa

SEQ ID NO: 9482 - RNA, 19 nt, Artificial Sequence
  Description of Artificial Sequence: Synthetic oligonucleotide
uugguaaguagaucugugc

SEQ ID NO: 9483 - RNA, 19 nt, Artificial Sequence
  Description of Artificial Sequence: Synthetic oligonucleotide
cacagaucuacuuaccaag

SEQ ID NO: 9484 - RNA, 19 nt, Artificial Sequence
  Description of Artificial Sequence: Synthetic oligonucleotide
cuugguaaguagaucugug

SEQ ID NO: 9485 - RNA, 19 nt, Artificial Sequence
  Description of Artificial Sequence: Synthetic oligonucleotide
acagaucuacuuaccaagc

SEQ ID NO: 9486 - RNA, 19 nt, Artificial Sequence
  Description of Artificial Sequence: Synthetic oligonucleotide
gcuugguaaguagaucugu

SEQ ID NO: 9487 - RNA, 19 nt, Artificial Sequence
  Description of Artificial Sequence: Synthetic oligonucleotide
cagaucuacuuaccaagcu

SEQ ID NO: 9488 - RNA, 19 nt, Artificial Sequence
  Description of Artificial Sequence: Synthetic oligonucleotide
agcuugguaaguagaucug

SEQ ID NO: 9489 - RNA, 19 nt, Artificial Sequence
  Description of Artificial Sequence: Synthetic oligonucleotide
agaucuacuuaccaagcug

SEQ ID NO: 9490 - RNA, 19 nt, Artificial Sequence
  Description of Artificial Sequence: Synthetic oligonucleotide
cagcuugguaaguagaucu

SEQ ID NO: 9491 - RNA, 19 nt, Artificial Sequence
  Description of Artificial Sequence: Synthetic oligonucleotide
aucuacuuaccaagcuggg

SEQ ID NO: 9492 - RNA, 19 nt, Artificial Sequence
  Description of Artificial Sequence: Synthetic oligonucleotide
cccagcuugguaaguagau

SEQ ID NO: 9493 - RNA, 19 nt, Artificial Sequence
  Description of Artificial Sequence: Synthetic oligonucleotide
ucuacuuaccaagcuggga

SEQ ID NO: 9494 - RNA, 19 nt, Artificial Sequence
  Description of Artificial Sequence: Synthetic oligonucleotide
ucccagcuugguaaguaga

SEQ ID NO: 9495 - RNA, 19 nt, Artificial Sequence
  Description of Artificial Sequence: Synthetic oligonucleotide
cuuaccaagcugggagcaa

SEQ ID NO: 9496 - RNA, 19 nt, Artificial Sequence
  Description of Artificial Sequence: Synthetic oligonucleotide
uugcucccagcuugguaag

SEQ ID NO: 9497 - RNA, 19 nt, Artificial Sequence
  Description of Artificial Sequence: Synthetic oligonucleotide
uuaccaagcugggagcaag

SEQ ID NO: 9498 - RNA, 19 nt, Artificial Sequence
  Description of Artificial Sequence: Synthetic oligonucleotide
cuugcucccagcuugguaa

SEQ ID NO: 9499 - RNA, 19 nt, Artificial Sequence
  Description of Artificial Sequence: Synthetic oligonucleotide
uaccaagcugggagcaagc

SEQ ID NO: 9500 - RNA, 19 nt, Artificial Sequence
  Description of Artificial Sequence: Synthetic oligonucleotide
gcuugcucccagcuuggua

SEQ ID NO: 9501 - RNA, 19 nt, Artificial Sequence
  Description of Artificial Sequence: Synthetic oligonucleotide
accaagcugggagcaagca

SEQ ID NO: 9502 - RNA, 19 nt, Artificial Sequence
  Description of Artificial Sequence: Synthetic oligonucleotide
ugcuugcucccagcuuggu

SEQ ID NO: 9503 - RNA, 19 nt, Artificial Sequence
  Description of Artificial Sequence: Synthetic oligonucleotide
gcugggagcaagcaggauu

SEQ ID NO: 9504 - RNA, 19 nt, Artificial Sequence
  Description of Artificial Sequence: Synthetic oligonucleotide
aauccugcuugcucccagc

SEQ ID NO: 9505 - RNA, 19 nt, Artificial Sequence
  Description of Artificial Sequence: Synthetic oligonucleotide
cugggagcaagcaggauug

SEQ ID NO: 9506 - RNA, 19 nt, Artificial Sequence
  Description of Artificial Sequence: Synthetic oligonucleotide
caauccugcuugcucccag

SEQ ID NO: 9507 - RNA, 19 nt, Artificial Sequence
  Description of Artificial Sequence: Synthetic oligonucleotide
ugggagcaagcaggauugg

SEQ ID NO: 9508 - RNA, 19 nt, Artificial Sequence
  Description of Artificial Sequence: Synthetic oligonucleotide
ccaauccugcuugcuccca

SEQ ID NO: 9509 - RNA, 19 nt, Artificial Sequence
  Description of Artificial Sequence: Synthetic oligonucleotide
gggagcaagcaggauuggg

SEQ ID NO: 9510 - RNA, 19 nt, Artificial Sequence
  Description of Artificial Sequence: Synthetic oligonucleotide
cccaauccugcuugcuccc

SEQ ID NO: 9511 - RNA, 19 nt, Artificial Sequence
  Description of Artificial Sequence: Synthetic oligonucleotide
aaagguuaagcagcaguag

SEQ ID NO: 9512 - RNA, 19 nt, Artificial Sequence
  Description of Artificial Sequence: Synthetic oligonucleotide
cuacugcugcuuaaccuuu

SEQ ID NO: 9513 - RNA, 19 nt, Artificial Sequence
  Description of Artificial Sequence: Synthetic oligonucleotide
aagguuaagcagcaguagg

SEQ ID NO: 9514 - RNA, 19 nt, Artificial Sequence
  Description of Artificial Sequence: Synthetic oligonucleotide
ccuacugcugcuuaaccuu

SEQ ID NO: 9515 - RNA, 19 nt, Artificial Sequence
  Description of Artificial Sequence: Synthetic oligonucleotide
agguuaagcagcaguaggc

SEQ ID NO: 9516 - RNA, 19 nt, Artificial Sequence
  Description of Artificial Sequence: Synthetic oligonucleotide
gccuacugcugcuuaaccu

SEQ ID NO: 9517 - RNA, 19 nt, Artificial Sequence
  Description of Artificial Sequence: Synthetic oligonucleotide
ggugccuacuccuguccug

SEQ ID NO: 9518 - RNA, 19 nt, Artificial Sequence
  Description of Artificial Sequence: Synthetic oligonucleotide
caggacaggaguaggcacc

SEQ ID NO: 9519 - RNA, 19 nt, Artificial Sequence
  Description of Artificial Sequence: Synthetic oligonucleotide
gugccuacuccuguccugu

SEQ ID NO: 9520 - RNA, 19 nt, Artificial Sequence
  Description of Artificial Sequence: Synthetic oligonucleotide
acaggacaggaguaggcac

SEQ ID NO: 9521 - RNA, 19 nt, Artificial Sequence
  Description of Artificial Sequence: Synthetic oligonucleotide
ugccuacuccuguccugug

SEQ ID NO: 9522 - RNA, 19 nt, Artificial Sequence
  Description of Artificial Sequence: Synthetic oligonucleotide
cacaggacaggaguaggca

SEQ ID NO: 9523 - RNA, 19 nt, Artificial Sequence
  Description of Artificial Sequence: Synthetic oligonucleotide
gccuacuccuguccugugc

SEQ ID NO: 9524 - RNA, 19 nt, Artificial Sequence
  Description of Artificial Sequence: Synthetic oligonucleotide
gcacaggacaggaguaggc

SEQ ID NO: 9525 - RNA, 19 nt, Artificial Sequence
  Description of Artificial Sequence: Synthetic oligonucleotide
ccuacuccuguccugugcc

SEQ ID NO: 9526 - RNA, 19 nt, Artificial Sequence
  Description of Artificial Sequence: Synthetic oligonucleotide
ggcacaggacaggaguagg

SEQ ID NO: 9527 - RNA, 19 nt, Artificial Sequence
  Description of Artificial Sequence: Synthetic oligonucleotide
cuacuccuguccugugccu

SEQ ID NO: 9528 - RNA, 19 nt, Artificial Sequence
  Description of Artificial Sequence: Synthetic oligonucleotide
aggcacaggacaggaguag

SEQ ID NO: 9529 - RNA, 19 nt, Artificial Sequence
  Description of Artificial Sequence: Synthetic oligonucleotide
uacuccuguccugugccua

SEQ ID NO: 9530 - RNA, 19 nt, Artificial Sequence
  Description of Artificial Sequence: Synthetic oligonucleotide
uaggcacaggacaggagua

SEQ ID NO: 9531 - RNA, 19 nt, Artificial Sequence
  Description of Artificial Sequence: Synthetic oligonucleotide
acuccuguccugugccuau

SEQ ID NO: 9532 - RNA, 19 nt, Artificial Sequence
  Description of Artificial Sequence: Synthetic oligonucleotide
auaggcacaggacaggagu

SEQ ID NO: 9533 - RNA, 19 nt, Artificial Sequence
  Description of Artificial Sequence: Synthetic oligonucleotide
cuccuguccugugccuauc

SEQ ID NO: 9534 - RNA, 19 nt, Artificial Sequence
  Description of Artificial Sequence: Synthetic oligonucleotide
gauaggcacaggacaggag

SEQ ID NO: 9535 - RNA, 19 nt, Artificial Sequence
  Description of Artificial Sequence: Synthetic oligonucleotide
uccuguccugugccuauca

SEQ ID NO: 9536 - RNA, 19 nt, Artificial Sequence
  Description of Artificial Sequence: Synthetic oligonucleotide
ugauaggcacaggacagga

SEQ ID NO: 9537 - RNA, 19 nt, Artificial Sequence
  Description of Artificial Sequence: Synthetic oligonucleotide
gugccuaucacauuugcag

SEQ ID NO: 9538 - RNA, 19 nt, Artificial Sequence
  Description of Artificial Sequence: Synthetic oligonucleotide
cugcaaaugugauaggcac

SEQ ID NO: 9539 - RNA, 19 nt, Artificial Sequence
  Description of Artificial Sequence: Synthetic oligonucleotide
cuaucacauuugcagaggg

SEQ ID NO: 9540 - RNA, 19 nt, Artificial Sequence
  Description of Artificial Sequence: Synthetic oligonucleotide
cccucugcaaaugugauag

SEQ ID NO: 9541 - RNA, 19 nt, Artificial Sequence
  Description of Artificial Sequence: Synthetic oligonucleotide
uaucacauuugcagagggu

SEQ ID NO: 9542 - RNA, 19 nt, Artificial Sequence
  Description of Artificial Sequence: Synthetic oligonucleotide
acccucugcaaaugugaua

SEQ ID NO: 9543 - RNA, 19 nt, Artificial Sequence
  Description of Artificial Sequence: Synthetic oligonucleotide
aucacauuugcagagggua

SEQ ID NO: 9544 - RNA, 19 nt, Artificial Sequence
  Description of Artificial Sequence: Synthetic oligonucleotide
uacccucugcaaaugugau

SEQ ID NO: 9545 - RNA, 19 nt, Artificial Sequence
  Description of Artificial Sequence: Synthetic oligonucleotide
ucacauuugcagaggguaa

SEQ ID NO: 9546 - RNA, 19 nt, Artificial Sequence
  Description of Artificial Sequence: Synthetic oligonucleotide
uuacccucugcaaauguga

SEQ ID NO: 9547 - RNA, 19 nt, Artificial Sequence
  Description of Artificial Sequence: Synthetic oligonucleotide
cacauuugcagaggguaag

SEQ ID NO: 9548 - RNA, 19 nt, Artificial Sequence
  Description of Artificial Sequence: Synthetic oligonucleotide
cuuacccucugcaaaugug

SEQ ID NO: 9549 - RNA, 19 nt, Artificial Sequence
  Description of Artificial Sequence: Synthetic oligonucleotide
acauuugcagaggguaaga

SEQ ID NO: 9550 - RNA, 19 nt, Artificial Sequence
  Description of Artificial Sequence: Synthetic oligonucleotide
ucuuacccucugcaaaugu

SEQ ID NO: 9551 - RNA, 19 nt, Artificial Sequence
  Description of Artificial Sequence: Synthetic oligonucleotide
gaccgccugcagaagguug

SEQ ID NO: 9552 - RNA, 19 nt, Artificial Sequence
  Description of Artificial Sequence: Synthetic oligonucleotide
caaccuucugcaggcgguc

SEQ ID NO: 9553 - RNA, 19 nt, Artificial Sequence
  Description of Artificial Sequence: Synthetic oligonucleotide
accgccugcagaagguuga

SEQ ID NO: 9554 - RNA, 19 nt, Artificial Sequence
  Description of Artificial Sequence: Synthetic oligonucleotide
ucaaccuucugcaggcggu

SEQ ID NO: 9555 - RNA, 19 nt, Artificial Sequence
  Description of Artificial Sequence: Synthetic oligonucleotide
ccgccugcagaagguugac

SEQ ID NO: 9556 - RNA, 19 nt, Artificial Sequence
  Description of Artificial Sequence: Synthetic oligonucleotide
gucaaccuucugcaggcgg

SEQ ID NO: 9557 - RNA, 19 nt, Artificial Sequence
  Description of Artificial Sequence: Synthetic oligonucleotide
cgccugcagaagguugacu

SEQ ID NO: 9558 - RNA, 19 nt, Artificial Sequence
  Description of Artificial Sequence: Synthetic oligonucleotide
agucaaccuucugcaggcg

SEQ ID NO: 9559 - RNA, 19 nt, Artificial Sequence
  Description of Artificial Sequence: Synthetic oligonucleotide
gccugcagaagguugacug

SEQ ID NO: 9560 - RNA, 19 nt, Artificial Sequence
  Description of Artificial Sequence: Synthetic oligonucleotide
cagucaaccuucugcaggc

SEQ ID NO: 9561 - RNA, 19 nt, Artificial Sequence
  Description of Artificial Sequence: Synthetic oligonucleotide
cagaagguugacugcgugg

SEQ ID NO: 9562 - RNA, 19 nt, Artificial Sequence
  Description of Artificial Sequence: Synthetic oligonucleotide
ccacgcagucaaccuucug

SEQ ID NO: 9563 - RNA, 19 nt, Artificial Sequence
  Description of Artificial Sequence: Synthetic oligonucleotide
agaagguugacugcguggu

SEQ ID NO: 9564 - RNA, 19 nt, Artificial Sequence
  Description of Artificial Sequence: Synthetic oligonucleotide
accacgcagucaaccuucu

SEQ ID NO: 9565 - RNA, 19 nt, Artificial Sequence
  Description of Artificial Sequence: Synthetic oligonucleotide
gaagguugacugcguggua

SEQ ID NO: 9566 - RNA, 19 nt, Artificial Sequence
  Description of Artificial Sequence: Synthetic oligonucleotide
uaccacgcagucaaccuuc

SEQ ID NO: 9567 - RNA, 19 nt, Artificial Sequence
  Description of Artificial Sequence: Synthetic oligonucleotide
aagguugacugcgugguag

SEQ ID NO: 9568 - RNA, 19 nt, Artificial Sequence
  Description of Artificial Sequence: Synthetic oligonucleotide
cuaccacgcagucaaccuu

SEQ ID NO: 9569 - RNA, 19 nt, Artificial Sequence
  Description of Artificial Sequence: Synthetic oligonucleotide
agguugacugcgugguagg

SEQ ID NO: 9570 - RNA, 19 nt, Artificial Sequence
  Description of Artificial Sequence: Synthetic oligonucleotide
ccuaccacgcagucaaccu

SEQ ID NO: 9571 - RNA, 19 nt, Artificial Sequence
  Description of Artificial Sequence: Synthetic oligonucleotide
gguugacugcgugguaggg

SEQ ID NO: 9572 - RNA, 19 nt, Artificial Sequence
  Description of Artificial Sequence: Synthetic oligonucleotide
cccuaccacgcagucaacc

SEQ ID NO: 9573 - RNA, 19 nt, Artificial Sequence
  Description of Artificial Sequence: Synthetic oligonucleotide
ccagagcaagccgaaggca

SEQ ID NO: 9574 - RNA, 19 nt, Artificial Sequence
  Description of Artificial Sequence: Synthetic oligonucleotide
ugccuucggcuugcucugg

SEQ ID NO: 9575 - RNA, 19 nt, Artificial Sequence
  Description of Artificial Sequence: Synthetic oligonucleotide
cagagcaagccgaaggcaa

SEQ ID NO: 9576 - RNA, 19 nt, Artificial Sequence
  Description of Artificial Sequence: Synthetic oligonucleotide
uugccuucggcuugcucug

SEQ ID NO: 9577 - RNA, 19 nt, Artificial Sequence
  Description of Artificial Sequence: Synthetic oligonucleotide
agagcaagccgaaggcaag

SEQ ID NO: 9578 - RNA, 19 nt, Artificial Sequence
  Description of Artificial Sequence: Synthetic oligonucleotide
cuugccuucggcuugcucu

SEQ ID NO: 9579 - RNA, 19 nt, Artificial Sequence
  Description of Artificial Sequence: Synthetic oligonucleotide
gagcaagccgaaggcaagc

SEQ ID NO: 9580 - RNA, 19 nt, Artificial Sequence
  Description of Artificial Sequence: Synthetic oligonucleotide
gcuugccuucggcuugcuc

SEQ ID NO: 9581 - RNA, 19 nt, Artificial Sequence
  Description of Artificial Sequence: Synthetic oligonucleotide
agcaagccgaaggcaagca

SEQ ID NO: 9582 - RNA, 19 nt, Artificial Sequence
  Description of Artificial Sequence: Synthetic oligonucleotide
ugcuugccuucggcuugcu

SEQ ID NO: 9583 - RNA, 19 nt, Artificial Sequence
  Description of Artificial Sequence: Synthetic oligonucleotide
gcaagccgaaggcaagcac

SEQ ID NO: 9584 - RNA, 19 nt, Artificial Sequence
  Description of Artificial Sequence: Synthetic oligonucleotide
gugcuugccuucggcuugc

SEQ ID NO: 9585 - RNA, 19 nt, Artificial Sequence
  Description of Artificial Sequence: Synthetic oligonucleotide
caagccgaaggcaagcacg

SEQ ID NO: 9586 - RNA, 19 nt, Artificial Sequence
  Description of Artificial Sequence: Synthetic oligonucleotide
cgugcuugccuucggcuug

SEQ ID NO: 9587 - RNA, 19 nt, Artificial Sequence
  Description of Artificial Sequence: Synthetic oligonucleotide
aagccgaaggcaagcacga

SEQ ID NO: 9588 - RNA, 19 nt, Artificial Sequence
  Description of Artificial Sequence: Synthetic oligonucleotide
ucgugcuugccuucggcuu

SEQ ID NO: 9589 - RNA, 19 nt, Artificial Sequence
  Description of Artificial Sequence: Synthetic oligonucleotide
agccgaaggcaagcacgau

SEQ ID NO: 9590 - RNA, 19 nt, Artificial Sequence
  Description of Artificial Sequence: Synthetic oligonucleotide
aucgugcuugccuucggcu

SEQ ID NO: 9591 - RNA, 19 nt, Artificial Sequence
  Description of Artificial Sequence: Synthetic oligonucleotide
gccgaaggcaagcacgaug

SEQ ID NO: 9592 - RNA, 19 nt, Artificial Sequence
  Description of Artificial Sequence: Synthetic oligonucleotide
caucgugcuugccuucggc

SEQ ID NO: 9593 - RNA, 19 nt, Artificial Sequence
  Description of Artificial Sequence: Synthetic oligonucleotide
aaggcaagcacgauggcgc

SEQ ID NO: 9594 - RNA, 19 nt, Artificial Sequence
  Description of Artificial Sequence: Synthetic oligonucleotide
gcgccaucgugcuugccuu

SEQ ID NO: 9595 - RNA, 19 nt, Artificial Sequence
  Description of Artificial Sequence: Synthetic oligonucleotide
aggcaagcacgauggcgcu

SEQ ID NO: 9596 - RNA, 19 nt, Artificial Sequence
  Description of Artificial Sequence: Synthetic oligonucleotide
agcgccaucgugcuugccu

SEQ ID NO: 9597 - RNA, 19 nt, Artificial Sequence
  Description of Artificial Sequence: Synthetic oligonucleotide
aagcacgauggcgcucacc

SEQ ID NO: 9598 - RNA, 19 nt, Artificial Sequence
  Description of Artificial Sequence: Synthetic oligonucleotide
ggugagcgccaucgugcuu

SEQ ID NO: 9599 - RNA, 19 nt, Artificial Sequence
  Description of Artificial Sequence: Synthetic oligonucleotide
agcacgauggcgcucacca

SEQ ID NO: 9600 - RNA, 19 nt, Artificial Sequence
  Description of Artificial Sequence: Synthetic oligonucleotide
uggugagcgccaucgugcu

SEQ ID NO: 9601 - RNA, 19 nt, Artificial Sequence
  Description of Artificial Sequence: Synthetic oligonucleotide
cuguagcagccgagcauca

SEQ ID NO: 9602 - RNA, 19 nt, Artificial Sequence
  Description of Artificial Sequence: Synthetic oligonucleotide
ugaugcucggcugcuacag

SEQ ID NO: 9603 - RNA, 19 nt, Artificial Sequence
  Description of Artificial Sequence: Synthetic oligonucleotide
agccgagcaucagcccgaa

SEQ ID NO: 9604 - RNA, 19 nt, Artificial Sequence
  Description of Artificial Sequence: Synthetic oligonucleotide
uucgggcugaugcucggcu

SEQ ID NO: 9605 - RNA, 19 nt, Artificial Sequence
  Description of Artificial Sequence: Synthetic oligonucleotide
gucagagucuccaggcuca

SEQ ID NO: 9606 - RNA, 19 nt, Artificial Sequence
  Description of Artificial Sequence: Synthetic oligonucleotide
ugagccuggagacucugac

SEQ ID NO: 9607 - RNA, 19 nt, Artificial Sequence
  Description of Artificial Sequence: Synthetic oligonucleotide
ucagagucuccaggcucag

SEQ ID NO: 9608 - RNA, 19 nt, Artificial Sequence
  Description of Artificial Sequence: Synthetic oligonucleotide
cugagccuggagacucuga

SEQ ID NO: 9609 - RNA, 19 nt, Artificial Sequence
  Description of Artificial Sequence: Synthetic oligonucleotide
cagagucuccaggcucagg

SEQ ID NO: 9610 - RNA, 19 nt, Artificial Sequence
  Description of Artificial Sequence: Synthetic oligonucleotide
ccugagccuggagacucug

SEQ ID NO: 9611 - RNA, 19 nt, Artificial Sequence
  Description of Artificial Sequence: Synthetic oligonucleotide
agagucuccaggcucaggu

SEQ ID NO: 9612 - RNA, 19 nt, Artificial Sequence
  Description of Artificial Sequence: Synthetic oligonucleotide
accugagccuggagacucu

SEQ ID NO: 9613 - RNA, 19 nt, Artificial Sequence
  Description of Artificial Sequence: Synthetic oligonucleotide
gagucuccaggcucaggug

SEQ ID NO: 9614 - RNA, 19 nt, Artificial Sequence
  Description of Artificial Sequence: Synthetic oligonucleotide
caccugagccuggagacuc

SEQ ID NO: 9615 - RNA, 19 nt, Artificial Sequence
  Description of Artificial Sequence: Synthetic oligonucleotide
agucuccaggcucaggugg

SEQ ID NO: 9616 - RNA, 19 nt, Artificial Sequence
  Description of Artificial Sequence: Synthetic oligonucleotide
ccaccugagccuggagacu

SEQ ID NO: 9617 - RNA, 19 nt, Artificial Sequence
  Description of Artificial Sequence: Synthetic oligonucleotide
ggguggcacagcuggcaua

SEQ ID NO: 9618 - RNA, 19 nt, Artificial Sequence
  Description of Artificial Sequence: Synthetic oligonucleotide
uaugccagcugugccaccc

SEQ ID NO: 9619 - RNA, 19 nt, Artificial Sequence
  Description of Artificial Sequence: Synthetic oligonucleotide
guggcacagcuggcauacg

SEQ ID NO: 9620 - RNA, 19 nt, Artificial Sequence
  Description of Artificial Sequence: Synthetic oligonucleotide
cguaugccagcugugccac

SEQ ID NO: 9621 - RNA, 19 nt, Artificial Sequence
  Description of Artificial Sequence: Synthetic oligonucleotide
uggcacagcuggcauacgc

SEQ ID NO: 9622 - RNA, 19 nt, Artificial Sequence
  Description of Artificial Sequence: Synthetic oligonucleotide
gcguaugccagcugugcca

SEQ ID NO: 9623 - RNA, 19 nt, Artificial Sequence
  Description of Artificial Sequence: Synthetic oligonucleotide
cuccacagguggcgguaga

SEQ ID NO: 9624 - RNA, 19 nt, Artificial Sequence
  Description of Artificial Sequence: Synthetic oligonucleotide
ucuaccgccaccuguggag

SEQ ID NO: 9625 - RNA, 19 nt, Artificial Sequence
  Description of Artificial Sequence: Synthetic oligonucleotide
uccacagguggcgguagac

SEQ ID NO: 9626 - RNA, 19 nt, Artificial Sequence
  Description of Artificial Sequence: Synthetic oligonucleotide
gucuaccgccaccugugga

SEQ ID NO: 9627 - RNA, 19 nt, Artificial Sequence
  Description of Artificial Sequence: Synthetic oligonucleotide
ugagcagcacgcuggcgua

SEQ ID NO: 9628 - RNA, 19 nt, Artificial Sequence
  Description of Artificial Sequence: Synthetic oligonucleotide
uacgccagcgugcugcuca

SEQ ID NO: 9629 - RNA, 19 nt, Artificial Sequence
  Description of Artificial Sequence: Synthetic oligonucleotide
agcagcacgcuggcguaca

SEQ ID NO: 9630 - RNA, 19 nt, Artificial Sequence
  Description of Artificial Sequence: Synthetic oligonucleotide
uguacgccagcgugcugcu

SEQ ID NO: 9631 - RNA, 19 nt, Artificial Sequence
  Description of Artificial Sequence: Synthetic oligonucleotide
gcagcacgcuggcguacau

SEQ ID NO: 9632 - RNA, 19 nt, Artificial Sequence
  Description of Artificial Sequence: Synthetic oligonucleotide
auguacgccagcgugcugc

SEQ ID NO: 9633 - RNA, 19 nt, Artificial Sequence
  Description of Artificial Sequence: Synthetic oligonucleotide
cagcacgcuggcguacaug

SEQ ID NO: 9634 - RNA, 19 nt, Artificial Sequence
  Description of Artificial Sequence: Synthetic oligonucleotide
cauguacgccagcgugcug

SEQ ID NO: 9635 - RNA, 19 nt, Artificial Sequence
  Description of Artificial Sequence: Synthetic oligonucleotide
agcacgcuggcguacaugc

SEQ ID NO: 9636 - RNA, 19 nt, Artificial Sequence
  Description of Artificial Sequence: Synthetic oligonucleotide
gcauguacgccagcgugcu

SEQ ID NO: 9637 - RNA, 19 nt, Artificial Sequence
  Description of Artificial Sequence: Synthetic oligonucleotide
gcacgcuggcguacaugcu

SEQ ID NO: 9638 - RNA, 19 nt, Artificial Sequence
  Description of Artificial Sequence: Synthetic oligonucleotide
agcauguacgccagcgugc

SEQ ID NO: 9639 - RNA, 19 nt, Artificial Sequence
  Description of Artificial Sequence: Synthetic oligonucleotide
cacgcuggcguacaugcug

SEQ ID NO: 9640 - RNA, 19 nt, Artificial Sequence
  Description of Artificial Sequence: Synthetic oligonucleotide
cagcauguacgccagcgug

SEQ ID NO: 9641 - RNA, 19 nt, Artificial Sequence
  Description of Artificial Sequence: Synthetic oligonucleotide
acgcuggcguacaugcuga

SEQ ID NO: 9642 - RNA, 19 nt, Artificial Sequence
  Description of Artificial Sequence: Synthetic oligonucleotide
ucagcauguacgccagcgu

SEQ ID NO: 9643 - RNA, 19 nt, Artificial Sequence
  Description of Artificial Sequence: Synthetic oligonucleotide
cuggcguacaugcugagcg

SEQ ID NO: 9644 - RNA, 19 nt, Artificial Sequence
  Description of Artificial Sequence: Synthetic oligonucleotide
cgcucagcauguacgccag

SEQ ID NO: 9645 - RNA, 19 nt, Artificial Sequence
  Description of Artificial Sequence: Synthetic oligonucleotide
uggcguacaugcugagcgc

SEQ ID NO: 9646 - RNA, 19 nt, Artificial Sequence
  Description of Artificial Sequence: Synthetic oligonucleotide
gcgcucagcauguacgcca

SEQ ID NO: 9647 - RNA, 19 nt, Artificial Sequence
  Description of Artificial Sequence: Synthetic oligonucleotide
cgcgcacacguaguacacc

SEQ ID NO: 9648 - RNA, 19 nt, Artificial Sequence
  Description of Artificial Sequence: Synthetic oligonucleotide
gguguacuacgugugcgcg

SEQ ID NO: 9649 - RNA, 19 nt, Artificial Sequence
  Description of Artificial Sequence: Synthetic oligonucleotide
gcgcacacguaguacaccg

SEQ ID NO: 9650 - RNA, 19 nt, Artificial Sequence
  Description of Artificial Sequence: Synthetic oligonucleotide
cgguguacuacgugugcgc

SEQ ID NO: 9651 - RNA, 19 nt, Artificial Sequence
  Description of Artificial Sequence: Synthetic oligonucleotide
cgcacacguaguacaccgc

SEQ ID NO: 9652 - RNA, 19 nt, Artificial Sequence
  Description of Artificial Sequence: Synthetic oligonucleotide
gcgguguacuacgugugcg

SEQ ID NO: 9653 - RNA, 19 nt, Artificial Sequence
  Description of Artificial Sequence: Synthetic oligonucleotide
gcacacguaguacaccgcc

SEQ ID NO: 9654 - RNA, 19 nt, Artificial Sequence
  Description of Artificial Sequence: Synthetic oligonucleotide
ggcgguguacuacgugugc

SEQ ID NO: 9655 - RNA, 19 nt, Artificial Sequence
  Description of Artificial Sequence: Synthetic oligonucleotide
cacacguaguacaccgccu

SEQ ID NO: 9656 - RNA, 19 nt, Artificial Sequence
  Description of Artificial Sequence: Synthetic oligonucleotide
aggcgguguacuacgugug

SEQ ID NO: 9657 - RNA, 19 nt, Artificial Sequence
  Description of Artificial Sequence: Synthetic oligonucleotide
acacguaguacaccgccuu

SEQ ID NO: 9658 - RNA, 19 nt, Artificial Sequence
  Description of Artificial Sequence: Synthetic oligonucleotide
aaggcgguguacuacgugu

SEQ ID NO: 9659 - RNA, 19 nt, Artificial Sequence
  Description of Artificial Sequence: Synthetic oligonucleotide
cacguaguacaccgccuug

SEQ ID NO: 9660 - RNA, 19 nt, Artificial Sequence
  Description of Artificial Sequence: Synthetic oligonucleotide
caaggcgguguacuacgug

SEQ ID NO: 9661 - RNA, 19 nt, Artificial Sequence
  Description of Artificial Sequence: Synthetic oligonucleotide
uaguacaccgccuugcagc

SEQ ID NO: 9662 - RNA, 19 nt, Artificial Sequence
  Description of Artificial Sequence: Synthetic oligonucleotide
gcugcaaggcgguguacua

SEQ ID NO: 9663 - RNA, 19 nt, Artificial Sequence
  Description of Artificial Sequence: Synthetic oligonucleotide
aguggacagugaggacuuc

SEQ ID NO: 9664 - RNA, 19 nt, Artificial Sequence
  Description of Artificial Sequence: Synthetic oligonucleotide
gaaguccucacuguccacu

SEQ ID NO: 9665 - RNA, 19 nt, Artificial Sequence
  Description of Artificial Sequence: Synthetic oligonucleotide
guggacagugaggacuucu

SEQ ID NO: 9666 - RNA, 19 nt, Artificial Sequence
  Description of Artificial Sequence: Synthetic oligonucleotide
agaaguccucacuguccac

SEQ ID NO: 9667 - RNA, 19 nt, Artificial Sequence
  Description of Artificial Sequence: Synthetic oligonucleotide
uggacagugaggacuucuu

SEQ ID NO: 9668 - RNA, 19 nt, Artificial Sequence
  Description of Artificial Sequence: Synthetic oligonucleotide
aagaaguccucacugucca

SEQ ID NO: 9669 - RNA, 19 nt, Artificial Sequence
  Description of Artificial Sequence: Synthetic oligonucleotide
ggacagugaggacuucuuc

SEQ ID NO: 9670 - RNA, 19 nt, Artificial Sequence
  Description of Artificial Sequence: Synthetic oligonucleotide
gaagaaguccucacugucc

SEQ ID NO: 9671 - RNA, 19 nt, Artificial Sequence
  Description of Artificial Sequence: Synthetic oligonucleotide
agugaggacuucuuccagc

SEQ ID NO: 9672 - RNA, 19 nt, Artificial Sequence
  Description of Artificial Sequence: Synthetic oligonucleotide
gcuggaagaaguccucacu

SEQ ID NO: 9673 - RNA, 19 nt, Artificial Sequence
  Description of Artificial Sequence: Synthetic oligonucleotide
gugaggacuucuuccagcu

SEQ ID NO: 9674 - RNA, 19 nt, Artificial Sequence
  Description of Artificial Sequence: Synthetic oligonucleotide
agcuggaagaaguccucac

SEQ ID NO: 9675 - RNA, 19 nt, Artificial Sequence
  Description of Artificial Sequence: Synthetic oligonucleotide
ugaggacuucuuccagcug

SEQ ID NO: 9676 - RNA, 19 nt, Artificial Sequence
  Description of Artificial Sequence: Synthetic oligonucleotide
cagcuggaagaaguccuca

SEQ ID NO: 9677 - RNA, 19 nt, Artificial Sequence
  Description of Artificial Sequence: Synthetic oligonucleotide
gaggacuucuuccagcugc

SEQ ID NO: 9678 - RNA, 19 nt, Artificial Sequence
  Description of Artificial Sequence: Synthetic oligonucleotide
gcagcuggaagaaguccuc

SEQ ID NO: 9679 - RNA, 19 nt, Artificial Sequence
  Description of Artificial Sequence: Synthetic oligonucleotide
gugccugaugguguugcag

SEQ ID NO: 9680 - RNA, 19 nt, Artificial Sequence
  Description of Artificial Sequence: Synthetic oligonucleotide
cugcaacaccaucaggcac

SEQ ID NO: 9681 - RNA, 19 nt, Artificial Sequence
  Description of Artificial Sequence: Synthetic oligonucleotide
gaugguguugcagucuggu

SEQ ID NO: 9682 - RNA, 19 nt, Artificial Sequence
  Description of Artificial Sequence: Synthetic oligonucleotide
accagacugcaacaccauc

SEQ ID NO: 9683 - RNA, 19 nt, Artificial Sequence
  Description of Artificial Sequence: Synthetic oligonucleotide
ugguguugcagucugguca

SEQ ID NO: 9684 - RNA, 19 nt, Artificial Sequence
  Description of Artificial Sequence: Synthetic oligonucleotide
ugaccagacugcaacacca

SEQ ID NO: 9685 - RNA, 19 nt, Artificial Sequence
  Description of Artificial Sequence: Synthetic oligonucleotide
gguguugcagucuggucag

SEQ ID NO: 9686 - RNA, 19 nt, Artificial Sequence
  Description of Artificial Sequence: Synthetic oligonucleotide
cugaccagacugcaacacc

SEQ ID NO: 9687 - RNA, 19 nt, Artificial Sequence
  Description of Artificial Sequence: Synthetic oligonucleotide
guguugcagucuggucaga

SEQ ID NO: 9688 - RNA, 19 nt, Artificial Sequence
  Description of Artificial Sequence: Synthetic oligonucleotide
ucugaccagacugcaacac

SEQ ID NO: 9689 - RNA, 19 nt, Artificial Sequence
  Description of Artificial Sequence: Synthetic oligonucleotide
ugcagucuggucagagcug

SEQ ID NO: 9690 - RNA, 19 nt, Artificial Sequence
  Description of Artificial Sequence: Synthetic oligonucleotide
cagcucugaccagacugca

SEQ ID NO: 9691 - RNA, 19 nt, Artificial Sequence
  Description of Artificial Sequence: Synthetic oligonucleotide
gcagucuggucagagcugg

SEQ ID NO: 9692 - RNA, 19 nt, Artificial Sequence
  Description of Artificial Sequence: Synthetic oligonucleotide
ccagcucugaccagacugc

SEQ ID NO: 9693 - RNA, 19 nt, Artificial Sequence
  Description of Artificial Sequence: Synthetic oligonucleotide
cagucuggucagagcugga

SEQ ID NO: 9694 - RNA, 19 nt, Artificial Sequence
  Description of Artificial Sequence: Synthetic oligonucleotide
uccagcucugaccagacug

SEQ ID NO: 9695 - RNA, 19 nt, Artificial Sequence
  Description of Artificial Sequence: Synthetic oligonucleotide
agucuggucagagcuggag

SEQ ID NO: 9696 - RNA, 19 nt, Artificial Sequence
  Description of Artificial Sequence: Synthetic oligonucleotide
cuccagcucugaccagacu

SEQ ID NO: 9697 - RNA, 19 nt, Artificial Sequence
  Description of Artificial Sequence: Synthetic oligonucleotide
gucuggucagagcuggagc

SEQ ID NO: 9698 - RNA, 19 nt, Artificial Sequence
  Description of Artificial Sequence: Synthetic oligonucleotide
gcuccagcucugaccagac

SEQ ID NO: 9699 - RNA, 19 nt, Artificial Sequence
  Description of Artificial Sequence: Synthetic oligonucleotide
ucuggucagagcuggagcc

SEQ ID NO: 9700 - RNA, 19 nt, Artificial Sequence
  Description of Artificial Sequence: Synthetic oligonucleotide
ggcuccagcucugaccaga

SEQ ID NO: 9701 - RNA, 19 nt, Artificial Sequence
  Description of Artificial Sequence: Synthetic oligonucleotide
uggucagagcuggagcccu

SEQ ID NO: 9702 - RNA, 19 nt, Artificial Sequence
  Description of Artificial Sequence: Synthetic oligonucleotide
agggcuccagcucugacca

SEQ ID NO: 9703 - RNA, 19 nt, Artificial Sequence
  Description of Artificial Sequence: Synthetic oligonucleotide
ggucagagcuggagcccua

SEQ ID NO: 9704 - RNA, 19 nt, Artificial Sequence
  Description of Artificial Sequence: Synthetic oligonucleotide
uagggcuccagcucugacc

SEQ ID NO: 9705 - RNA, 19 nt, Artificial Sequence
  Description of Artificial Sequence: Synthetic oligonucleotide
gucagagcuggagcccuac

SEQ ID NO: 9706 - RNA, 19 nt, Artificial Sequence
  Description of Artificial Sequence: Synthetic oligonucleotide
guagggcuccagcucugac

SEQ ID NO: 9707 - RNA, 19 nt, Artificial Sequence
  Description of Artificial Sequence: Synthetic oligonucleotide
caaggguaagaggccuaua

SEQ ID NO: 9708 - RNA, 19 nt, Artificial Sequence
  Description of Artificial Sequence: Synthetic oligonucleotide
uauaggccucuuacccuug

SEQ ID NO: 9709 - RNA, 19 nt, Artificial Sequence
  Description of Artificial Sequence: Synthetic oligonucleotide
aaggguaagaggccuauac

SEQ ID NO: 9710 - RNA, 19 nt, Artificial Sequence
  Description of Artificial Sequence: Synthetic oligonucleotide
guauaggccucuuacccuu

SEQ ID NO: 9711 - RNA, 19 nt, Artificial Sequence
  Description of Artificial Sequence: Synthetic oligonucleotide
aggguaagaggccuauacu

SEQ ID NO: 9712 - RNA, 19 nt, Artificial Sequence
  Description of Artificial Sequence: Synthetic oligonucleotide
aguauaggccucuuacccu

SEQ ID NO: 9713 - RNA, 19 nt, Artificial Sequence
  Description of Artificial Sequence: Synthetic oligonucleotide
ggguaagaggccuauacug

SEQ ID NO: 9714 - RNA, 19 nt, Artificial Sequence
  Description of Artificial Sequence: Synthetic oligonucleotide
caguauaggccucuuaccc

SEQ ID NO: 9715 - RNA, 19 nt, Artificial Sequence
  Description of Artificial Sequence: Synthetic oligonucleotide
gguaagaggccuauacugg

SEQ ID NO: 9716 - RNA, 19 nt, Artificial Sequence
  Description of Artificial Sequence: Synthetic oligonucleotide
ccaguauaggccucuuacc

SEQ ID NO: 9717 - RNA, 19 nt, Artificial Sequence
  Description of Artificial Sequence: Synthetic oligonucleotide
guaagaggccuauacuggg

SEQ ID NO: 9718 - RNA, 19 nt, Artificial Sequence
  Description of Artificial Sequence: Synthetic oligonucleotide
cccaguauaggccucuuac

SEQ ID NO: 9719 - RNA, 19 nt, Artificial Sequence
  Description of Artificial Sequence: Synthetic oligonucleotide
gggcugcuuccaaugccug

SEQ ID NO: 9720 - RNA, 19 nt, Artificial Sequence
  Description of Artificial Sequence: Synthetic oligonucleotide
caggcauuggaagcagccc

SEQ ID NO: 9721 - RNA, 19 nt, Artificial Sequence
  Description of Artificial Sequence: Synthetic oligonucleotide
ggcugcuuccaaugccugu

SEQ ID NO: 9722 - RNA, 19 nt, Artificial Sequence
  Description of Artificial Sequence: Synthetic oligonucleotide
acaggcauuggaagcagcc

SEQ ID NO: 9723 - RNA, 19 nt, Artificial Sequence
  Description of Artificial Sequence: Synthetic oligonucleotide
gcugcuuccaaugccuguc

SEQ ID NO: 9724 - RNA, 19 nt, Artificial Sequence
  Description of Artificial Sequence: Synthetic oligonucleotide
gacaggcauuggaagcagc

SEQ ID NO: 9725 - RNA, 19 nt, Artificial Sequence
  Description of Artificial Sequence: Synthetic oligonucleotide
cugcuuccaaugccugucc

SEQ ID NO: 9726 - RNA, 19 nt, Artificial Sequence
  Description of Artificial Sequence: Synthetic oligonucleotide
ggacaggcauuggaagcag

SEQ ID NO: 9727 - RNA, 19 nt, Artificial Sequence
  Description of Artificial Sequence: Synthetic oligonucleotide
ugcuuccaaugccuguccu

SEQ ID NO: 9728 - RNA, 19 nt, Artificial Sequence
  Description of Artificial Sequence: Synthetic oligonucleotide
aggacaggcauuggaagca

SEQ ID NO: 9729 - RNA, 19 nt, Artificial Sequence
  Description of Artificial Sequence: Synthetic oligonucleotide
gcuuccaaugccuguccuu

SEQ ID NO: 9730 - RNA, 19 nt, Artificial Sequence
  Description of Artificial Sequence: Synthetic oligonucleotide
aaggacaggcauuggaagc

SEQ ID NO: 9731 - RNA, 19 nt, Artificial Sequence
  Description of Artificial Sequence: Synthetic oligonucleotide
cuuccaaugccuguccuuu

SEQ ID NO: 9732 - RNA, 19 nt, Artificial Sequence
  Description of Artificial Sequence: Synthetic oligonucleotide
aaaggacaggcauuggaag

SEQ ID NO: 9733 - RNA, 19 nt, Artificial Sequence
  Description of Artificial Sequence: Synthetic oligonucleotide
uuccaaugccuguccuuua

SEQ ID NO: 9734 - RNA, 19 nt, Artificial Sequence
  Description of Artificial Sequence: Synthetic oligonucleotide
uaaaggacaggcauuggaa

SEQ ID NO: 9735 - RNA, 19 nt, Artificial Sequence
  Description of Artificial Sequence: Synthetic oligonucleotide
uccaaugccuguccuuuag

SEQ ID NO: 9736 - RNA, 19 nt, Artificial Sequence
  Description of Artificial Sequence: Synthetic oligonucleotide
cuaaaggacaggcauugga

SEQ ID NO: 9737 - RNA, 19 nt, Artificial Sequence
  Description of Artificial Sequence: Synthetic oligonucleotide
caaugccuguccuuuagag

SEQ ID NO: 9738 - RNA, 19 nt, Artificial Sequence
  Description of Artificial Sequence: Synthetic oligonucleotide
cucuaaaggacaggcauug

SEQ ID NO: 9739 - RNA, 19 nt, Artificial Sequence
  Description of Artificial Sequence: Synthetic oligonucleotide
aaugccuguccuuuagagc

SEQ ID NO: 9740 - RNA, 19 nt, Artificial Sequence
  Description of Artificial Sequence: Synthetic oligonucleotide
gcucuaaaggacaggcauu

SEQ ID NO: 9741 - RNA, 19 nt, Artificial Sequence
  Description of Artificial Sequence: Synthetic oligonucleotide
augccuguccuuuagagcu

SEQ ID NO: 9742 - RNA, 19 nt, Artificial Sequence
  Description of Artificial Sequence: Synthetic oligonucleotide
agcucuaaaggacaggcau

SEQ ID NO: 9743 - RNA, 19 nt, Artificial Sequence
  Description of Artificial Sequence: Synthetic oligonucleotide
cuuccucucuagcuuaacc

SEQ ID NO: 9744 - RNA, 19 nt, Artificial Sequence
  Description of Artificial Sequence: Synthetic oligonucleotide
gguuaagcuagagaggaag

SEQ ID NO: 9745 - RNA, 19 nt, Artificial Sequence
  Description of Artificial Sequence: Synthetic oligonucleotide
uuccucucuagcuuaaccc

SEQ ID NO: 9746 - RNA, 19 nt, Artificial Sequence
  Description of Artificial Sequence: Synthetic oligonucleotide
ggguuaagcuagagaggaa

SEQ ID NO: 9747 - RNA, 19 nt, Artificial Sequence
  Description of Artificial Sequence: Synthetic oligonucleotide
ucucuagcuuaacccugau

SEQ ID NO: 9748 - RNA, 19 nt, Artificial Sequence
  Description of Artificial Sequence: Synthetic oligonucleotide
aucaggguuaagcuagaga

SEQ ID NO: 9749 - RNA, 19 nt, Artificial Sequence
  Description of Artificial Sequence: Synthetic oligonucleotide
uagcuuaacccugauccug

SEQ ID NO: 9750 - RNA, 19 nt, Artificial Sequence
  Description of Artificial Sequence: Synthetic oligonucleotide
caggaucaggguuaagcua

SEQ ID NO: 9751 - RNA, 19 nt, Artificial Sequence
  Description of Artificial Sequence: Synthetic oligonucleotide
gaccaggugcaggaggagu

SEQ ID NO: 9752 - RNA, 19 nt, Artificial Sequence
  Description of Artificial Sequence: Synthetic oligonucleotide
acuccuccugcaccugguc

SEQ ID NO: 9753 - RNA, 19 nt, Artificial Sequence
  Description of Artificial Sequence: Synthetic oligonucleotide
accaggugcaggaggaguu

SEQ ID NO: 9754 - RNA, 19 nt, Artificial Sequence
  Description of Artificial Sequence: Synthetic oligonucleotide
aacuccuccugcaccuggu

SEQ ID NO: 9755 - RNA, 19 nt, Artificial Sequence
  Description of Artificial Sequence: Synthetic oligonucleotide
ccaggugcaggaggaguug

SEQ ID NO: 9756 - RNA, 19 nt, Artificial Sequence
  Description of Artificial Sequence: Synthetic oligonucleotide
caacuccuccugcaccugg

SEQ ID NO: 9757 - RNA, 19 nt, Artificial Sequence
  Description of Artificial Sequence: Synthetic oligonucleotide
caggugcaggaggaguugu

SEQ ID NO: 9758 - RNA, 19 nt, Artificial Sequence
  Description of Artificial Sequence: Synthetic oligonucleotide
acaacuccuccugcaccug

SEQ ID NO: 9759 - RNA, 19 nt, Artificial Sequence
  Description of Artificial Sequence: Synthetic oligonucleotide
aggugcaggaggaguugug

SEQ ID NO: 9760 - RNA, 19 nt, Artificial Sequence
  Description of Artificial Sequence: Synthetic oligonucleotide
cacaacuccuccugcaccu

SEQ ID NO: 9761 - RNA, 19 nt, Artificial Sequence
  Description of Artificial Sequence: Synthetic oligonucleotide
ugcaggaggaguuguggaa

SEQ ID NO: 9762 - RNA, 19 nt, Artificial Sequence
  Description of Artificial Sequence: Synthetic oligonucleotide
uuccacaacuccuccugca

SEQ ID NO: 9763 - RNA, 19 nt, Artificial Sequence
  Description of Artificial Sequence: Synthetic oligonucleotide
gcaggaggaguuguggaau

SEQ ID NO: 9764 - RNA, 19 nt, Artificial Sequence
  Description of Artificial Sequence: Synthetic oligonucleotide
auuccacaacuccuccugc

SEQ ID NO: 9765 - RNA, 19 nt, Artificial Sequence
  Description of Artificial Sequence: Synthetic oligonucleotide
aggaggaguuguggaauug

SEQ ID NO: 9766 - RNA, 19 nt, Artificial Sequence
  Description of Artificial Sequence: Synthetic oligonucleotide
caauuccacaacuccuccu

SEQ ID NO: 9767 - RNA, 19 nt, Artificial Sequence
  Description of Artificial Sequence: Synthetic oligonucleotide
ggaggaguuguggaauugu

SEQ ID NO: 9768 - RNA, 19 nt, Artificial Sequence
  Description of Artificial Sequence: Synthetic oligonucleotide
acaauuccacaacuccucc

SEQ ID NO: 9769 - RNA, 19 nt, Artificial Sequence
  Description of Artificial Sequence: Synthetic oligonucleotide
gaggaguuguggaauuguc

SEQ ID NO: 9770 - RNA, 19 nt, Artificial Sequence
  Description of Artificial Sequence: Synthetic oligonucleotide
gacaauuccacaacuccuc

SEQ ID NO: 9771 - RNA, 19 nt, Artificial Sequence
  Description of Artificial Sequence: Synthetic oligonucleotide
aggaguuguggaauuguca

SEQ ID NO: 9772 - RNA, 19 nt, Artificial Sequence
  Description of Artificial Sequence: Synthetic oligonucleotide
ugacaauuccacaacuccu

SEQ ID NO: 9773 - RNA, 19 nt, Artificial Sequence
  Description of Artificial Sequence: Synthetic oligonucleotide
ggaguuguggaauugucaa

SEQ ID NO: 9774 - RNA, 19 nt, Artificial Sequence
  Description of Artificial Sequence: Synthetic oligonucleotide
uugacaauuccacaacucc

SEQ ID NO: 9775 - RNA, 19 nt, Artificial Sequence
  Description of Artificial Sequence: Synthetic oligonucleotide
gaguuguggaauugucaag

SEQ ID NO: 9776 - RNA, 19 nt, Artificial Sequence
  Description of Artificial Sequence: Synthetic oligonucleotide
cuugacaauuccacaacuc

SEQ ID NO: 9777 - RNA, 19 nt, Artificial Sequence
  Description of Artificial Sequence: Synthetic oligonucleotide
aguuguggaauugucaagg

SEQ ID NO: 9778 - RNA, 19 nt, Artificial Sequence
  Description of Artificial Sequence: Synthetic oligonucleotide
ccuugacaauuccacaacu

SEQ ID NO: 9779 - RNA, 19 nt, Artificial Sequence
  Description of Artificial Sequence: Synthetic oligonucleotide
guuguggaauugucaagga

SEQ ID NO: 9780 - RNA, 19 nt, Artificial Sequence
  Description of Artificial Sequence: Synthetic oligonucleotide
uccuugacaauuccacaac

SEQ ID NO: 9781 - RNA, 19 nt, Artificial Sequence
  Description of Artificial Sequence: Synthetic oligonucleotide
uggaauugucaaggauguc

SEQ ID NO: 9782 - RNA, 19 nt, Artificial Sequence
  Description of Artificial Sequence: Synthetic oligonucleotide
gacauccuugacaauucca

SEQ ID NO: 9783 - RNA, 19 nt, Artificial Sequence
  Description of Artificial Sequence: Synthetic oligonucleotide
ggaauugucaaggauguca

SEQ ID NO: 9784 - RNA, 19 nt, Artificial Sequence
  Description of Artificial Sequence: Synthetic oligonucleotide
ugacauccuugacaauucc

SEQ ID NO: 9785 - RNA, 19 nt, Artificial Sequence
  Description of Artificial Sequence: Synthetic oligonucleotide
aguccaagcgagggagggu

SEQ ID NO: 9786 - RNA, 19 nt, Artificial Sequence
  Description of Artificial Sequence: Synthetic oligonucleotide
acccucccucgcuuggacu

SEQ ID NO: 9787 - RNA, 19 nt, Artificial Sequence
  Description of Artificial Sequence: Synthetic oligonucleotide
caagcgagggagggucuga

SEQ ID NO: 9788 - RNA, 19 nt, Artificial Sequence
  Description of Artificial Sequence: Synthetic oligonucleotide
ucagacccucccucgcuug

SEQ ID NO: 9789 - RNA, 19 nt, Artificial Sequence
  Description of Artificial Sequence: Synthetic oligonucleotide
aagcgagggagggucugac

SEQ ID NO: 9790 - RNA, 19 nt, Artificial Sequence
  Description of Artificial Sequence: Synthetic oligonucleotide
gucagacccucccucgcuu

SEQ ID NO: 9791 - RNA, 19 nt, Artificial Sequence
  Description of Artificial Sequence: Synthetic oligonucleotide
cugacccagugcugaugga

SEQ ID NO: 9792 - RNA, 19 nt, Artificial Sequence
  Description of Artificial Sequence: Synthetic oligonucleotide
uccaucagcacugggucag

SEQ ID NO: 9793 - RNA, 19 nt, Artificial Sequence
  Description of Artificial Sequence: Synthetic oligonucleotide
agauuaguggugggugucu

SEQ ID NO: 9794 - RNA, 19 nt, Artificial Sequence
  Description of Artificial Sequence: Synthetic oligonucleotide
agacacccaccacuaaucu

SEQ ID NO: 9795 - RNA, 19 nt, Artificial Sequence
  Description of Artificial Sequence: Synthetic oligonucleotide
auuaguggugggugucugg

SEQ ID NO: 9796 - RNA, 19 nt, Artificial Sequence
  Description of Artificial Sequence: Synthetic oligonucleotide
ccagacacccaccacuaau

SEQ ID NO: 9797 - RNA, 19 nt, Artificial Sequence
  Description of Artificial Sequence: Synthetic oligonucleotide
uuaguggugggugucuggu

SEQ ID NO: 9798 - RNA, 19 nt, Artificial Sequence
  Description of Artificial Sequence: Synthetic oligonucleotide
accagacacccaccacuaa

SEQ ID NO: 9799 - RNA, 19 nt, Artificial Sequence
  Description of Artificial Sequence: Synthetic oligonucleotide
uaguggugggugucuggua

SEQ ID NO: 9800 - RNA, 19 nt, Artificial Sequence
  Description of Artificial Sequence: Synthetic oligonucleotide
uaccagacacccaccacua

SEQ ID NO: 9801 - RNA, 19 nt, Artificial Sequence
  Description of Artificial Sequence: Synthetic oligonucleotide
aguggugggugucugguau

SEQ ID NO: 9802 - RNA, 19 nt, Artificial Sequence
  Description of Artificial Sequence: Synthetic oligonucleotide
auaccagacacccaccacu

SEQ ID NO: 9803 - RNA, 19 nt, Artificial Sequence
  Description of Artificial Sequence: Synthetic oligonucleotide
guggugggugucugguaug

SEQ ID NO: 9804 - RNA, 19 nt, Artificial Sequence
  Description of Artificial Sequence: Synthetic oligonucleotide
cauaccagacacccaccac

SEQ ID NO: 9805 - RNA, 19 nt, Artificial Sequence
  Description of Artificial Sequence: Synthetic oligonucleotide
uggugggugucugguauga

SEQ ID NO: 9806 - RNA, 19 nt, Artificial Sequence
  Description of Artificial Sequence: Synthetic oligonucleotide
ucauaccagacacccacca

SEQ ID NO: 9807 - RNA, 19 nt, Artificial Sequence
  Description of Artificial Sequence: Synthetic oligonucleotide
ggugggugucugguaugag

SEQ ID NO: 9808 - RNA, 19 nt, Artificial Sequence
  Description of Artificial Sequence: Synthetic oligonucleotide
cucauaccagacacccacc

SEQ ID NO: 9809 - RNA, 19 nt, Artificial Sequence
  Description of Artificial Sequence: Synthetic oligonucleotide
gugggugucugguaugagg

SEQ ID NO: 9810 - RNA, 19 nt, Artificial Sequence
  Description of Artificial Sequence: Synthetic oligonucleotide
ccucauaccagacacccac

SEQ ID NO: 9811 - RNA, 19 nt, Artificial Sequence
  Description of Artificial Sequence: Synthetic oligonucleotide
ugggugucugguaugagga

SEQ ID NO: 9812 - RNA, 19 nt, Artificial Sequence
  Description of Artificial Sequence: Synthetic oligonucleotide
uccucauaccagacaccca

SEQ ID NO: 9813 - RNA, 19 nt, Artificial Sequence
  Description of Artificial Sequence: Synthetic oligonucleotide
gggugucugguaugaggau

SEQ ID NO: 9814 - RNA, 19 nt, Artificial Sequence
  Description of Artificial Sequence: Synthetic oligonucleotide
auccucauaccagacaccc

SEQ ID NO: 9815 - RNA, 19 nt, Artificial Sequence
  Description of Artificial Sequence: Synthetic oligonucleotide
ggugucugguaugaggauc

SEQ ID NO: 9816 - RNA, 19 nt, Artificial Sequence
  Description of Artificial Sequence: Synthetic oligonucleotide
gauccucauaccagacacc

SEQ ID NO: 9817 - RNA, 19 nt, Artificial Sequence
  Description of Artificial Sequence: Synthetic oligonucleotide
gugucugguaugaggaucu

SEQ ID NO: 9818 - RNA, 19 nt, Artificial Sequence
  Description of Artificial Sequence: Synthetic oligonucleotide
agauccucauaccagacac

SEQ ID NO: 9819 - RNA, 19 nt, Artificial Sequence
  Description of Artificial Sequence: Synthetic oligonucleotide
ugucugguaugaggaucua

SEQ ID NO: 9820 - RNA, 19 nt, Artificial Sequence
  Description of Artificial Sequence: Synthetic oligonucleotide
uagauccucauaccagaca

SEQ ID NO: 9821 - RNA, 19 nt, Artificial Sequence
  Description of Artificial Sequence: Synthetic oligonucleotide
caaggguguccuacagagu

SEQ ID NO: 9822 - RNA, 19 nt, Artificial Sequence
  Description of Artificial Sequence: Synthetic oligonucleotide
acucuguaggacacccuug

SEQ ID NO: 9823 - RNA, 19 nt, Artificial Sequence
  Description of Artificial Sequence: Synthetic oligonucleotide
aaggguguccuacagagug

SEQ ID NO: 9824 - RNA, 19 nt, Artificial Sequence
  Description of Artificial Sequence: Synthetic oligonucleotide
cacucuguaggacacccuu

SEQ ID NO: 9825 - RNA, 19 nt, Artificial Sequence
  Description of Artificial Sequence: Synthetic oligonucleotide
aggguguccuacagagugg

SEQ ID NO: 9826 - RNA, 19 nt, Artificial Sequence
  Description of Artificial Sequence: Synthetic oligonucleotide
ccacucuguaggacacccu

SEQ ID NO: 9827 - RNA, 19 nt, Artificial Sequence
  Description of Artificial Sequence: Synthetic oligonucleotide
ggguguccuacagagugga

SEQ ID NO: 9828 - RNA, 19 nt, Artificial Sequence
  Description of Artificial Sequence: Synthetic oligonucleotide
uccacucuguaggacaccc

SEQ ID NO: 9829 - RNA, 19 nt, Artificial Sequence
  Description of Artificial Sequence: Synthetic oligonucleotide
gguguccuacagaguggag

SEQ ID NO: 9830 - RNA, 19 nt, Artificial Sequence
  Description of Artificial Sequence: Synthetic oligonucleotide
cuccacucuguaggacacc

SEQ ID NO: 9831 - RNA, 19 nt, Artificial Sequence
  Description of Artificial Sequence: Synthetic oligonucleotide
uccuacagaguggagugcu

SEQ ID NO: 9832 - RNA, 19 nt, Artificial Sequence
  Description of Artificial Sequence: Synthetic oligonucleotide
agcacuccacucuguagga

SEQ ID NO: 9833 - RNA, 19 nt, Artificial Sequence
  Description of Artificial Sequence: Synthetic oligonucleotide
aguggagugcugucauaug

SEQ ID NO: 9834 - RNA, 19 nt, Artificial Sequence
  Description of Artificial Sequence: Synthetic oligonucleotide
cauaugacagcacuccacu

SEQ ID NO: 9835 - RNA, 19 nt, Artificial Sequence
  Description of Artificial Sequence: Synthetic oligonucleotide
guggagugcugucauaugg

SEQ ID NO: 9836 - RNA, 19 nt, Artificial Sequence
  Description of Artificial Sequence: Synthetic oligonucleotide
ccauaugacagcacuccac

SEQ ID NO: 9837 - RNA, 19 nt, Artificial Sequence
  Description of Artificial Sequence: Synthetic oligonucleotide
uggagugcugucauauggc

SEQ ID NO: 9838 - RNA, 19 nt, Artificial Sequence
  Description of Artificial Sequence: Synthetic oligonucleotide
gccauaugacagcacucca

SEQ ID NO: 9839 - RNA, 19 nt, Artificial Sequence
  Description of Artificial Sequence: Synthetic oligonucleotide
ggagugcugucauauggcc

SEQ ID NO: 9840 - RNA, 19 nt, Artificial Sequence
  Description of Artificial Sequence: Synthetic oligonucleotide
ggccauaugacagcacucc

SEQ ID NO: 9841 - RNA, 19 nt, Artificial Sequence
  Description of Artificial Sequence: Synthetic oligonucleotide
gagugcugucauauggccu

SEQ ID NO: 9842 - RNA, 19 nt, Artificial Sequence
  Description of Artificial Sequence: Synthetic oligonucleotide
aggccauaugacagcacuc

SEQ ID NO: 9843 - RNA, 19 nt, Artificial Sequence
  Description of Artificial Sequence: Synthetic oligonucleotide
agugcugucauauggccug

SEQ ID NO: 9844 - RNA, 19 nt, Artificial Sequence
  Description of Artificial Sequence: Synthetic oligonucleotide
caggccauaugacagcacu

SEQ ID NO: 9845 - RNA, 19 nt, Artificial Sequence
  Description of Artificial Sequence: Synthetic oligonucleotide
gugcugucauauggccugg

SEQ ID NO: 9846 - RNA, 19 nt, Artificial Sequence
  Description of Artificial Sequence: Synthetic oligonucleotide
ccaggccauaugacagcac

SEQ ID NO: 9847 - RNA, 19 nt, Artificial Sequence
  Description of Artificial Sequence: Synthetic oligonucleotide
ugcugucauauggccuggg

SEQ ID NO: 9848 - RNA, 19 nt, Artificial Sequence
  Description of Artificial Sequence: Synthetic oligonucleotide
cccaggccauaugacagca

SEQ ID NO: 9849 - RNA, 19 nt, Artificial Sequence
  Description of Artificial Sequence: Synthetic oligonucleotide
gcugucauauggccuggga

SEQ ID NO: 9850 - RNA, 19 nt, Artificial Sequence
  Description of Artificial Sequence: Synthetic oligonucleotide
ucccaggccauaugacagc

SEQ ID NO: 9851 - RNA, 19 nt, Artificial Sequence
  Description of Artificial Sequence: Synthetic oligonucleotide
cugucauauggccugggac

SEQ ID NO: 9852 - RNA, 19 nt, Artificial Sequence
  Description of Artificial Sequence: Synthetic oligonucleotide
gucccaggccauaugacag

SEQ ID NO: 9853 - RNA, 19 nt, Artificial Sequence
  Description of Artificial Sequence: Synthetic oligonucleotide
ugucauauggccugggacg

SEQ ID NO: 9854 - RNA, 19 nt, Artificial Sequence
  Description of Artificial Sequence: Synthetic oligonucleotide
cgucccaggccauaugaca

SEQ ID NO: 9855 - RNA, 19 nt, Artificial Sequence
  Description of Artificial Sequence: Synthetic oligonucleotide
gucauauggccugggacgg

SEQ ID NO: 9856 - RNA, 19 nt, Artificial Sequence
  Description of Artificial Sequence: Synthetic oligonucleotide
ccgucccaggccauaugac

SEQ ID NO: 9857 - RNA, 19 nt, Artificial Sequence
  Description of Artificial Sequence: Synthetic oligonucleotide
agaggcccaagcacagcaa

SEQ ID NO: 9858 - RNA, 19 nt, Artificial Sequence
  Description of Artificial Sequence: Synthetic oligonucleotide
uugcugugcuugggccucu

SEQ ID NO: 9859 - RNA, 19 nt, Artificial Sequence
  Description of Artificial Sequence: Synthetic oligonucleotide
gaggcccaagcacagcaag

SEQ ID NO: 9860 - RNA, 19 nt, Artificial Sequence
  Description of Artificial Sequence: Synthetic oligonucleotide
cuugcugugcuugggccuc

SEQ ID NO: 9861 - RNA, 19 nt, Artificial Sequence
  Description of Artificial Sequence: Synthetic oligonucleotide
aggcccaagcacagcaagg

SEQ ID NO: 9862 - RNA, 19 nt, Artificial Sequence
  Description of Artificial Sequence: Synthetic oligonucleotide
ccuugcugugcuugggccu

SEQ ID NO: 9863 - RNA, 19 nt, Artificial Sequence
  Description of Artificial Sequence: Synthetic oligonucleotide
ggcccaagcacagcaagga

SEQ ID NO: 9864 - RNA, 19 nt, Artificial Sequence
  Description of Artificial Sequence: Synthetic oligonucleotide
uccuugcugugcuugggcc

SEQ ID NO: 9865 - RNA, 19 nt, Artificial Sequence
  Description of Artificial Sequence: Synthetic oligonucleotide
ccaagcacagcaaggacau

SEQ ID NO: 9866 - RNA, 19 nt, Artificial Sequence
  Description of Artificial Sequence: Synthetic oligonucleotide
auguccuugcugugcuugg

SEQ ID NO: 9867 - RNA, 19 nt, Artificial Sequence
  Description of Artificial Sequence: Synthetic oligonucleotide
gcccgauucaccuuugacg

SEQ ID NO: 9868 - RNA, 19 nt, Artificial Sequence
  Description of Artificial Sequence: Synthetic oligonucleotide
cgucaaaggugaaucgggc

SEQ ID NO: 9869 - RNA, 19 nt, Artificial Sequence
  Description of Artificial Sequence: Synthetic oligonucleotide
gauucaccuuugacgugua

SEQ ID NO: 9870 - RNA, 19 nt, Artificial Sequence
  Description of Artificial Sequence: Synthetic oligonucleotide
uacacgucaaaggugaauc

SEQ ID NO: 9871 - RNA, 19 nt, Artificial Sequence
  Description of Artificial Sequence: Synthetic oligonucleotide
auucaccuuugacguguac

SEQ ID NO: 9872 - RNA, 19 nt, Artificial Sequence
  Description of Artificial Sequence: Synthetic oligonucleotide
guacacgucaaaggugaau

SEQ ID NO: 9873 - RNA, 19 nt, Artificial Sequence
  Description of Artificial Sequence: Synthetic oligonucleotide
uuggcagccugaaugucaa

SEQ ID NO: 9874 - RNA, 19 nt, Artificial Sequence
  Description of Artificial Sequence: Synthetic oligonucleotide
uugacauucaggcugccaa

SEQ ID NO: 9875 - RNA, 19 nt, Artificial Sequence
  Description of Artificial Sequence: Synthetic oligonucleotide
uggcagccugaaugucaaa

SEQ ID NO: 9876 - RNA, 19 nt, Artificial Sequence
  Description of Artificial Sequence: Synthetic oligonucleotide
uuugacauucaggcugcca

SEQ ID NO: 9877 - RNA, 19 nt, Artificial Sequence
  Description of Artificial Sequence: Synthetic oligonucleotide
ggcagccugaaugucaaag

SEQ ID NO: 9878 - RNA, 19 nt, Artificial Sequence
  Description of Artificial Sequence: Synthetic oligonucleotide
cuuugacauucaggcugcc

SEQ ID NO: 9879 - RNA, 19 nt, Artificial Sequence
  Description of Artificial Sequence: Synthetic oligonucleotide
gcagccugaaugucaaagc

SEQ ID NO: 9880 - RNA, 19 nt, Artificial Sequence
  Description of Artificial Sequence: Synthetic oligonucleotide
gcuuugacauucaggcugc

SEQ ID NO: 9881 - RNA, 19 nt, Artificial Sequence
  Description of Artificial Sequence: Synthetic oligonucleotide
cagccugaaugucaaagcc

SEQ ID NO: 9882 - RNA, 19 nt, Artificial Sequence
  Description of Artificial Sequence: Synthetic oligonucleotide
ggcuuugacauucaggcug

SEQ ID NO: 9883 - RNA, 19 nt, Artificial Sequence
  Description of Artificial Sequence: Synthetic oligonucleotide
agccugaaugucaaagcca

SEQ ID NO: 9884 - RNA, 19 nt, Artificial Sequence
  Description of Artificial Sequence: Synthetic oligonucleotide
uggcuuugacauucaggcu

SEQ ID NO: 9885 - RNA, 19 nt, Artificial Sequence
  Description of Artificial Sequence: Synthetic oligonucleotide
gccugaaugucaaagccac

SEQ ID NO: 9886 - RNA, 19 nt, Artificial Sequence
  Description of Artificial Sequence: Synthetic oligonucleotide
guggcuuugacauucaggc

SEQ ID NO: 9887 - RNA, 19 nt, Artificial Sequence
  Description of Artificial Sequence: Synthetic oligonucleotide
gucaaagccacauucuacg

SEQ ID NO: 9888 - RNA, 19 nt, Artificial Sequence
  Description of Artificial Sequence: Synthetic oligonucleotide
cguagaauguggcuuugac

SEQ ID NO: 9889 - RNA, 19 nt, Artificial Sequence
  Description of Artificial Sequence: Synthetic oligonucleotide
ucaaagccacauucuacgg

SEQ ID NO: 9890 - RNA, 19 nt, Artificial Sequence
  Description of Artificial Sequence: Synthetic oligonucleotide
ccguagaauguggcuuuga

SEQ ID NO: 9891 - RNA, 19 nt, Artificial Sequence
  Description of Artificial Sequence: Synthetic oligonucleotide
caaagccacauucuacggg

SEQ ID NO: 9892 - RNA, 19 nt, Artificial Sequence
  Description of Artificial Sequence: Synthetic oligonucleotide
cccguagaauguggcuuug

SEQ ID NO: 9893 - RNA, 19 nt, Artificial Sequence
  Description of Artificial Sequence: Synthetic oligonucleotide
aaagccacauucuacgggc

SEQ ID NO: 9894 - RNA, 19 nt, Artificial Sequence
  Description of Artificial Sequence: Synthetic oligonucleotide
gcccguagaauguggcuuu

SEQ ID NO: 9895 - RNA, 19 nt, Artificial Sequence
  Description of Artificial Sequence: Synthetic oligonucleotide
gccacauucuacgggcucu

SEQ ID NO: 9896 - RNA, 19 nt, Artificial Sequence
  Description of Artificial Sequence: Synthetic oligonucleotide
agagcccguagaauguggc

SEQ ID NO: 9897 - RNA, 19 nt, Artificial Sequence
  Description of Artificial Sequence: Synthetic oligonucleotide
ccacauucuacgggcucua

SEQ ID NO: 9898 - RNA, 19 nt, Artificial Sequence
  Description of Artificial Sequence: Synthetic oligonucleotide
uagagcccguagaaugugg

SEQ ID NO: 9899 - RNA, 19 nt, Artificial Sequence
  Description of Artificial Sequence: Synthetic oligonucleotide
cacauucuacgggcucuac

SEQ ID NO: 9900 - RNA, 19 nt, Artificial Sequence
  Description of Artificial Sequence: Synthetic oligonucleotide
guagagcccguagaaugug

SEQ ID NO: 9901 - RNA, 19 nt, Artificial Sequence
  Description of Artificial Sequence: Synthetic oligonucleotide
uucuacgggcucuacucua

SEQ ID NO: 9902 - RNA, 19 nt, Artificial Sequence
  Description of Artificial Sequence: Synthetic oligonucleotide
uagaguagagcccguagaa

SEQ ID NO: 9903 - RNA, 19 nt, Artificial Sequence
  Description of Artificial Sequence: Synthetic oligonucleotide
ucuacgggcucuacucuau

SEQ ID NO: 9904 - RNA, 19 nt, Artificial Sequence
  Description of Artificial Sequence: Synthetic oligonucleotide
auagaguagagcccguaga

SEQ ID NO: 9905 - RNA, 19 nt, Artificial Sequence
  Description of Artificial Sequence: Synthetic oligonucleotide
cuacgggcucuacucuaug

SEQ ID NO: 9906 - RNA, 19 nt, Artificial Sequence
  Description of Artificial Sequence: Synthetic oligonucleotide
cauagaguagagcccguag

SEQ ID NO: 9907 - RNA, 19 nt, Artificial Sequence
  Description of Artificial Sequence: Synthetic oligonucleotide
cucuaugaguugugacuuu

SEQ ID NO: 9908 - RNA, 19 nt, Artificial Sequence
  Description of Artificial Sequence: Synthetic oligonucleotide
aaagucacaacucauagag

SEQ ID NO: 9909 - RNA, 19 nt, Artificial Sequence
  Description of Artificial Sequence: Synthetic oligonucleotide
ucuaugaguugugacuuuc

SEQ ID NO: 9910 - RNA, 19 nt, Artificial Sequence
  Description of Artificial Sequence: Synthetic oligonucleotide
gaaagucacaacucauaga

SEQ ID NO: 9911 - RNA, 19 nt, Artificial Sequence
  Description of Artificial Sequence: Synthetic oligonucleotide
ugaguugugacuuucaagg

SEQ ID NO: 9912 - RNA, 19 nt, Artificial Sequence
  Description of Artificial Sequence: Synthetic oligonucleotide
ccuugaaagucacaacuca

SEQ ID NO: 9913 - RNA, 19 nt, Artificial Sequence
  Description of Artificial Sequence: Synthetic oligonucleotide
gaguugugacuuucaagga

SEQ ID NO: 9914 - RNA, 19 nt, Artificial Sequence
  Description of Artificial Sequence: Synthetic oligonucleotide
uccuugaaagucacaacuc

SEQ ID NO: 9915 - RNA, 19 nt, Artificial Sequence
  Description of Artificial Sequence: Synthetic oligonucleotide
aguugugacuuucaaggac

SEQ ID NO: 9916 - RNA, 19 nt, Artificial Sequence
  Description of Artificial Sequence: Synthetic oligonucleotide
guccuugaaagucacaacu

SEQ ID NO: 9917 - RNA, 19 nt, Artificial Sequence
  Description of Artificial Sequence: Synthetic oligonucleotide
guugugacuuucaaggacu

SEQ ID NO: 9918 - RNA, 19 nt, Artificial Sequence
  Description of Artificial Sequence: Synthetic oligonucleotide
aguccuugaaagucacaac

SEQ ID NO: 9919 - RNA, 19 nt, Artificial Sequence
  Description of Artificial Sequence: Synthetic oligonucleotide
gacuuucaaggacuuggcc

SEQ ID NO: 9920 - RNA, 19 nt, Artificial Sequence
  Description of Artificial Sequence: Synthetic oligonucleotide
ggccaaguccuugaaaguc

SEQ ID NO: 9921 - RNA, 19 nt, Artificial Sequence
  Description of Artificial Sequence: Synthetic oligonucleotide
uuucaaggacuuggcccaa

SEQ ID NO: 9922 - RNA, 19 nt, Artificial Sequence
  Description of Artificial Sequence: Synthetic oligonucleotide
uugggccaaguccuugaaa

SEQ ID NO: 9923 - RNA, 19 nt, Artificial Sequence
  Description of Artificial Sequence: Synthetic oligonucleotide
uucaaggacuuggcccaaa

SEQ ID NO: 9924 - RNA, 19 nt, Artificial Sequence
  Description of Artificial Sequence: Synthetic oligonucleotide
uuugggccaaguccuugaa

SEQ ID NO: 9925 - RNA, 19 nt, Artificial Sequence
  Description of Artificial Sequence: Synthetic oligonucleotide
cccuacaguuggauagucc

SEQ ID NO: 9926 - RNA, 19 nt, Artificial Sequence
  Description of Artificial Sequence: Synthetic oligonucleotide
ggacuauccaacuguaggg

SEQ ID NO: 9927 - RNA, 19 nt, Artificial Sequence
  Description of Artificial Sequence: Synthetic oligonucleotide
ccuacaguuggauaguccc

SEQ ID NO: 9928 - RNA, 19 nt, Artificial Sequence
  Description of Artificial Sequence: Synthetic oligonucleotide
gggacuauccaacuguagg

SEQ ID NO: 9929 - RNA, 19 nt, Artificial Sequence
  Description of Artificial Sequence: Synthetic oligonucleotide
auucguccucuugcaccca

SEQ ID NO: 9930 - RNA, 19 nt, Artificial Sequence
  Description of Artificial Sequence: Synthetic oligonucleotide
ugggugcaagaggacgaau

SEQ ID NO: 9931 - RNA, 19 nt, Artificial Sequence
  Description of Artificial Sequence: Synthetic oligonucleotide
uucguccucuugcacccac

SEQ ID NO: 9932 - RNA, 19 nt, Artificial Sequence
  Description of Artificial Sequence: Synthetic oligonucleotide
gugggugcaagaggacgaa

SEQ ID NO: 9933 - RNA, 19 nt, Artificial Sequence
  Description of Artificial Sequence: Synthetic oligonucleotide
uccucuugcacccaccuac

SEQ ID NO: 9934 - RNA, 19 nt, Artificial Sequence
  Description of Artificial Sequence: Synthetic oligonucleotide
guaggugggugcaagagga

SEQ ID NO: 9935 - RNA, 19 nt, Artificial Sequence
  Description of Artificial Sequence: Synthetic oligonucleotide
ccucuugcacccaccuacc

SEQ ID NO: 9936 - RNA, 19 nt, Artificial Sequence
  Description of Artificial Sequence: Synthetic oligonucleotide
gguaggugggugcaagagg

SEQ ID NO: 9937 - RNA, 19 nt, Artificial Sequence
  Description of Artificial Sequence: Synthetic oligonucleotide
cucuugcacccaccuaccc

SEQ ID NO: 9938 - RNA, 19 nt, Artificial Sequence
  Description of Artificial Sequence: Synthetic oligonucleotide
ggguaggugggugcaagag

SEQ ID NO: 9939 - RNA, 19 nt, Artificial Sequence
  Description of Artificial Sequence: Synthetic oligonucleotide
cuaguuagcucuugcuugu

SEQ ID NO: 9940 - RNA, 19 nt, Artificial Sequence
  Description of Artificial Sequence: Synthetic oligonucleotide
acaagcaagagcuaacuag

SEQ ID NO: 9941 - RNA, 19 nt, Artificial Sequence
  Description of Artificial Sequence: Synthetic oligonucleotide
uaguuagcucuugcuugug

SEQ ID NO: 9942 - RNA, 19 nt, Artificial Sequence
  Description of Artificial Sequence: Synthetic oligonucleotide
cacaagcaagagcuaacua

SEQ ID NO: 9943 - RNA, 19 nt, Artificial Sequence
  Description of Artificial Sequence: Synthetic oligonucleotide
aguuagcucuugcuugugg

SEQ ID NO: 9944 - RNA, 19 nt, Artificial Sequence
  Description of Artificial Sequence: Synthetic oligonucleotide
ccacaagcaagagcuaacu

SEQ ID NO: 9945 - RNA, 19 nt, Artificial Sequence
  Description of Artificial Sequence: Synthetic oligonucleotide
uuagcucuugcuuguggaa

SEQ ID NO: 9946 - RNA, 19 nt, Artificial Sequence
  Description of Artificial Sequence: Synthetic oligonucleotide
uuccacaagcaagagcuaa

SEQ ID NO: 9947 - RNA, 19 nt, Artificial Sequence
  Description of Artificial Sequence: Synthetic oligonucleotide
uccucaucucccagcuuga

SEQ ID NO: 9948 - RNA, 19 nt, Artificial Sequence
  Description of Artificial Sequence: Synthetic oligonucleotide
ucaagcugggagaugagga

SEQ ID NO: 9949 - RNA, 19 nt, Artificial Sequence
  Description of Artificial Sequence: Synthetic oligonucleotide
aucucccagcuugauggcu

SEQ ID NO: 9950 - RNA, 19 nt, Artificial Sequence
  Description of Artificial Sequence: Synthetic oligonucleotide
agccaucaagcugggagau

SEQ ID NO: 9951 - RNA, 19 nt, Artificial Sequence
  Description of Artificial Sequence: Synthetic oligonucleotide
ucucccagcuugauggcuu

SEQ ID NO: 9952 - RNA, 19 nt, Artificial Sequence
  Description of Artificial Sequence: Synthetic oligonucleotide
aagccaucaagcugggaga

SEQ ID NO: 9953 - RNA, 19 nt, Artificial Sequence
  Description of Artificial Sequence: Synthetic oligonucleotide
cucccagcuugauggcuuc

SEQ ID NO: 9954 - RNA, 19 nt, Artificial Sequence
  Description of Artificial Sequence: Synthetic oligonucleotide
gaagccaucaagcugggag

SEQ ID NO: 9955 - RNA, 19 nt, Artificial Sequence
  Description of Artificial Sequence: Synthetic oligonucleotide
ucccagcuugauggcuucc

SEQ ID NO: 9956 - RNA, 19 nt, Artificial Sequence
  Description of Artificial Sequence: Synthetic oligonucleotide
ggaagccaucaagcuggga

SEQ ID NO: 9957 - RNA, 19 nt, Artificial Sequence
  Description of Artificial Sequence: Synthetic oligonucleotide
cccagcuugauggcuuccu

SEQ ID NO: 9958 - RNA, 19 nt, Artificial Sequence
  Description of Artificial Sequence: Synthetic oligonucleotide
aggaagccaucaagcuggg

SEQ ID NO: 9959 - RNA, 19 nt, Artificial Sequence
  Description of Artificial Sequence: Synthetic oligonucleotide
ccagcuugauggcuuccuc

SEQ ID NO: 9960 - RNA, 19 nt, Artificial Sequence
  Description of Artificial Sequence: Synthetic oligonucleotide
gaggaagccaucaagcugg

SEQ ID NO: 9961 - RNA, 19 nt, Artificial Sequence
  Description of Artificial Sequence: Synthetic oligonucleotide
ugauggcuuccucccaagu

SEQ ID NO: 9962 - RNA, 19 nt, Artificial Sequence
  Description of Artificial Sequence: Synthetic oligonucleotide
acuugggaggaagccauca

SEQ ID NO: 9963 - RNA, 19 nt, Artificial Sequence
  Description of Artificial Sequence: Synthetic oligonucleotide
gauggcuuccucccaaguu

SEQ ID NO: 9964 - RNA, 19 nt, Artificial Sequence
  Description of Artificial Sequence: Synthetic oligonucleotide
aacuugggaggaagccauc

SEQ ID NO: 9965 - RNA, 19 nt, Artificial Sequence
  Description of Artificial Sequence: Synthetic oligonucleotide
ggcuuccucccaaguuuuc

SEQ ID NO: 9966 - RNA, 19 nt, Artificial Sequence
  Description of Artificial Sequence: Synthetic oligonucleotide
gaaaacuugggaggaagcc

SEQ ID NO: 9967 - RNA, 19 nt, Artificial Sequence
  Description of Artificial Sequence: Synthetic oligonucleotide
ccucccaaguuuuccaaau

SEQ ID NO: 9968 - RNA, 19 nt, Artificial Sequence
  Description of Artificial Sequence: Synthetic oligonucleotide
auuuggaaaacuugggagg

SEQ ID NO: 9969 - RNA, 19 nt, Artificial Sequence
  Description of Artificial Sequence: Synthetic oligonucleotide
cccaaguuuuccaaaucau

SEQ ID NO: 9970 - RNA, 19 nt, Artificial Sequence
  Description of Artificial Sequence: Synthetic oligonucleotide
augauuuggaaaacuuggg

SEQ ID NO: 9971 - RNA, 19 nt, Artificial Sequence
  Description of Artificial Sequence: Synthetic oligonucleotide
ccaaguuuuccaaaucauc

SEQ ID NO: 9972 - RNA, 19 nt, Artificial Sequence
  Description of Artificial Sequence: Synthetic oligonucleotide
gaugauuuggaaaacuugg

SEQ ID NO: 9973 - RNA, 19 nt, Artificial Sequence
  Description of Artificial Sequence: Synthetic oligonucleotide
caaguuuuccaaaucaucu

SEQ ID NO: 9974 - RNA, 19 nt, Artificial Sequence
  Description of Artificial Sequence: Synthetic oligonucleotide
agaugauuuggaaaacuug

SEQ ID NO: 9975 - RNA, 19 nt, Artificial Sequence
  Description of Artificial Sequence: Synthetic oligonucleotide
aaguuuuccaaaucaucug

SEQ ID NO: 9976 - RNA, 19 nt, Artificial Sequence
  Description of Artificial Sequence: Synthetic oligonucleotide
cagaugauuuggaaaacuu

SEQ ID NO: 9977 - RNA, 19 nt, Artificial Sequence
  Description of Artificial Sequence: Synthetic oligonucleotide
guuuuccaaaucaucugau

SEQ ID NO: 9978 - RNA, 19 nt, Artificial Sequence
  Description of Artificial Sequence: Synthetic oligonucleotide
aucagaugauuuggaaaac

SEQ ID NO: 9979 - RNA, 19 nt, Artificial Sequence
  Description of Artificial Sequence: Synthetic oligonucleotide
aucugauuuccucuugucu

SEQ ID NO: 9980 - RNA, 19 nt, Artificial Sequence
  Description of Artificial Sequence: Synthetic oligonucleotide
agacaagaggaaaucagau

SEQ ID NO: 9981 - RNA, 19 nt, Artificial Sequence
  Description of Artificial Sequence: Synthetic oligonucleotide
ucugauuuccucuugucuc

SEQ ID NO: 9982 - RNA, 19 nt, Artificial Sequence
  Description of Artificial Sequence: Synthetic oligonucleotide
gagacaagaggaaaucaga

SEQ ID NO: 9983 - RNA, 19 nt, Artificial Sequence
  Description of Artificial Sequence: Synthetic oligonucleotide
cugauuuccucuugucucu

SEQ ID NO: 9984 - RNA, 19 nt, Artificial Sequence
  Description of Artificial Sequence: Synthetic oligonucleotide
agagacaagaggaaaucag

SEQ ID NO: 9985 - RNA, 19 nt, Artificial Sequence
  Description of Artificial Sequence: Synthetic oligonucleotide
cucuugucucugccauuca

SEQ ID NO: 9986 - RNA, 19 nt, Artificial Sequence
  Description of Artificial Sequence: Synthetic oligonucleotide
ugaauggcagagacaagag

SEQ ID NO: 9987 - RNA, 19 nt, Artificial Sequence
  Description of Artificial Sequence: Synthetic oligonucleotide
guuggaccuccacacugcu

SEQ ID NO: 9988 - RNA, 19 nt, Artificial Sequence
  Description of Artificial Sequence: Synthetic oligonucleotide
agcaguguggagguccaac

SEQ ID NO: 9989 - RNA, 19 nt, Artificial Sequence
  Description of Artificial Sequence: Synthetic oligonucleotide
ccacacugcugcaaggccu

SEQ ID NO: 9990 - RNA, 19 nt, Artificial Sequence
  Description of Artificial Sequence: Synthetic oligonucleotide
aggccuugcagcagugugg

SEQ ID NO: 9991 - RNA, 19 nt, Artificial Sequence
  Description of Artificial Sequence: Synthetic oligonucleotide
cacacugcugcaaggccug

SEQ ID NO: 9992 - RNA, 19 nt, Artificial Sequence
  Description of Artificial Sequence: Synthetic oligonucleotide
caggccuugcagcagugug

SEQ ID NO: 9993 - RNA, 19 nt, Artificial Sequence
  Description of Artificial Sequence: Synthetic oligonucleotide
acacugcugcaaggccugg

SEQ ID NO: 9994 - RNA, 19 nt, Artificial Sequence
  Description of Artificial Sequence: Synthetic oligonucleotide
ccaggccuugcagcagugu

SEQ ID NO: 9995 - RNA, 19 nt, Artificial Sequence
  Description of Artificial Sequence: Synthetic oligonucleotide
ugcaaggccugggccauau

SEQ ID NO: 9996 - RNA, 19 nt, Artificial Sequence
  Description of Artificial Sequence: Synthetic oligonucleotide
auauggcccaggccuugca

SEQ ID NO: 9997 - RNA, 19 nt, Artificial Sequence
  Description of Artificial Sequence: Synthetic oligonucleotide
gcaaggccugggccauaug

SEQ ID NO: 9998 - RNA, 19 nt, Artificial Sequence
  Description of Artificial Sequence: Synthetic oligonucleotide
cauauggcccaggccuugc

SEQ ID NO: 9999 - RNA, 19 nt, Artificial Sequence
  Description of Artificial Sequence: Synthetic oligonucleotide
caaggccugggccauaugu

SEQ ID NO: 10000 - RNA, 19 nt, Artificial Sequence
  Description of Artificial Sequence: Synthetic oligonucleotide
acauauggcccaggccuug

SEQ ID NO: 10001 - RNA, 19 nt, Artificial Sequence
  Description of Artificial Sequence: Synthetic oligonucleotide
aaggccugggccauauguu

SEQ ID NO: 10002 - RNA, 19 nt, Artificial Sequence
  Description of Artificial Sequence: Synthetic oligonucleotide
aacauauggcccaggccuu

SEQ ID NO: 10003 - RNA, 19 nt, Artificial Sequence
  Description of Artificial Sequence: Synthetic oligonucleotide
aggccugggccauauguug

SEQ ID NO: 10004 - RNA, 19 nt, Artificial Sequence
  Description of Artificial Sequence: Synthetic oligonucleotide
caacauauggcccaggccu

SEQ ID NO: 10005 - RNA, 19 nt, Artificial Sequence
  Description of Artificial Sequence: Synthetic oligonucleotide
ggccugggccauauguugc

SEQ ID NO: 10006 - RNA, 19 nt, Artificial Sequence
  Description of Artificial Sequence: Synthetic oligonucleotide
gcaacauauggcccaggcc

SEQ ID NO: 10007 - RNA, 19 nt, Artificial Sequence
  Description of Artificial Sequence: Synthetic oligonucleotide
gccugggccauauguugcu

SEQ ID NO: 10008 - RNA, 19 nt, Artificial Sequence
  Description of Artificial Sequence: Synthetic oligonucleotide
agcaacauauggcccaggc

SEQ ID NO: 10009 - RNA, 19 nt, Artificial Sequence
  Description of Artificial Sequence: Synthetic oligonucleotide
ccugggccauauguugcug

SEQ ID NO: 10010 - RNA, 19 nt, Artificial Sequence
  Description of Artificial Sequence: Synthetic oligonucleotide
cagcaacauauggcccagg

SEQ ID NO: 10011 - RNA, 19 nt, Artificial Sequence
  Description of Artificial Sequence: Synthetic oligonucleotide
ggccauauguugcugggaa

SEQ ID NO: 10012 - RNA, 19 nt, Artificial Sequence
  Description of Artificial Sequence: Synthetic oligonucleotide
uucccagcaacauauggcc

SEQ ID NO: 10013 - RNA, 19 nt, Artificial Sequence
  Description of Artificial Sequence: Synthetic oligonucleotide
ccauauguugcugggaauu

SEQ ID NO: 10014 - RNA, 19 nt, Artificial Sequence
  Description of Artificial Sequence: Synthetic oligonucleotide
aauucccagcaacauaugg

SEQ ID NO: 10015 - RNA, 19 nt, Artificial Sequence
  Description of Artificial Sequence: Synthetic oligonucleotide
ggaauuuccuccacccuuc

SEQ ID NO: 10016 - RNA, 19 nt, Artificial Sequence
  Description of Artificial Sequence: Synthetic oligonucleotide
gaaggguggaggaaauucc

SEQ ID NO: 10017 - RNA, 19 nt, Artificial Sequence
  Description of Artificial Sequence: Synthetic oligonucleotide
gaauuuccuccacccuucg

SEQ ID NO: 10018 - RNA, 19 nt, Artificial Sequence
  Description of Artificial Sequence: Synthetic oligonucleotide
cgaaggguggaggaaauuc

SEQ ID NO: 10019 - RNA, 19 nt, Artificial Sequence
  Description of Artificial Sequence: Synthetic oligonucleotide
aauuuccuccacccuucgu

SEQ ID NO: 10020 - RNA, 19 nt, Artificial Sequence
  Description of Artificial Sequence: Synthetic oligonucleotide
acgaaggguggaggaaauu

SEQ ID NO: 10021 - RNA, 19 nt, Artificial Sequence
  Description of Artificial Sequence: Synthetic oligonucleotide
auuuccuccacccuucguc

SEQ ID NO: 10022 - RNA, 19 nt, Artificial Sequence
  Description of Artificial Sequence: Synthetic oligonucleotide
gacgaaggguggaggaaau

SEQ ID NO: 10023 - RNA, 19 nt, Artificial Sequence
  Description of Artificial Sequence: Synthetic oligonucleotide
uuuccuccacccuucguca

SEQ ID NO: 10024 - RNA, 19 nt, Artificial Sequence
  Description of Artificial Sequence: Synthetic oligonucleotide
ugacgaaggguggaggaaa

SEQ ID NO: 10025 - RNA, 19 nt, Artificial Sequence
  Description of Artificial Sequence: Synthetic oligonucleotide
uuccuccacccuucgucau

SEQ ID NO: 10026 - RNA, 19 nt, Artificial Sequence
  Description of Artificial Sequence: Synthetic oligonucleotide
augacgaaggguggaggaa

SEQ ID NO: 10027 - RNA, 19 nt, Artificial Sequence
  Description of Artificial Sequence: Synthetic oligonucleotide
uccuccacccuucgucaug

SEQ ID NO: 10028 - RNA, 19 nt, Artificial Sequence
  Description of Artificial Sequence: Synthetic oligonucleotide
caugacgaaggguggagga

SEQ ID NO: 10029 - RNA, 19 nt, Artificial Sequence
  Description of Artificial Sequence: Synthetic oligonucleotide
ccuccacccuucgucaugc

SEQ ID NO: 10030 - RNA, 19 nt, Artificial Sequence
  Description of Artificial Sequence: Synthetic oligonucleotide
gcaugacgaaggguggagg

SEQ ID NO: 10031 - RNA, 19 nt, Artificial Sequence
  Description of Artificial Sequence: Synthetic oligonucleotide
cuccacccuucgucaugca

SEQ ID NO: 10032 - RNA, 19 nt, Artificial Sequence
  Description of Artificial Sequence: Synthetic oligonucleotide
ugcaugacgaaggguggag

SEQ ID NO: 10033 - RNA, 19 nt, Artificial Sequence
  Description of Artificial Sequence: Synthetic oligonucleotide
ccuucgucaugcaguggag

SEQ ID NO: 10034 - RNA, 19 nt, Artificial Sequence
  Description of Artificial Sequence: Synthetic oligonucleotide
cuccacugcaugacgaagg

SEQ ID NO: 10035 - RNA, 19 nt, Artificial Sequence
  Description of Artificial Sequence: Synthetic oligonucleotide
cuucgucaugcaguggagg

SEQ ID NO: 10036 - RNA, 19 nt, Artificial Sequence
  Description of Artificial Sequence: Synthetic oligonucleotide
ccuccacugcaugacgaag

SEQ ID NO: 10037 - RNA, 19 nt, Artificial Sequence
  Description of Artificial Sequence: Synthetic oligonucleotide
uucgucaugcaguggaggg

SEQ ID NO: 10038 - RNA, 19 nt, Artificial Sequence
  Description of Artificial Sequence: Synthetic oligonucleotide
cccuccacugcaugacgaa

SEQ ID NO: 10039 - RNA, 19 nt, Artificial Sequence
  Description of Artificial Sequence: Synthetic oligonucleotide
cgccuccauuccuacuaag

SEQ ID NO: 10040 - RNA, 19 nt, Artificial Sequence
  Description of Artificial Sequence: Synthetic oligonucleotide
cuuaguaggaauggaggcg

SEQ ID NO: 10041 - RNA, 19 nt, Artificial Sequence
  Description of Artificial Sequence: Synthetic oligonucleotide
gccuccauuccuacuaagg

SEQ ID NO: 10042 - RNA, 19 nt, Artificial Sequence
  Description of Artificial Sequence: Synthetic oligonucleotide
ccuuaguaggaauggaggc

SEQ ID NO: 10043 - RNA, 19 nt, Artificial Sequence
  Description of Artificial Sequence: Synthetic oligonucleotide
ccuccauuccuacuaaggg

SEQ ID NO: 10044 - RNA, 19 nt, Artificial Sequence
  Description of Artificial Sequence: Synthetic oligonucleotide
cccuuaguaggaauggagg

SEQ ID NO: 10045 - protein, 6 aa, Artificial Sequence
  Description of Artificial Sequence: Synthetic 6xHis tag
HHHHHH

What is claimed is:

1. A method of treating a subject with a cell death inducing DFFA like effector B (CIDEB) inhibitor, wherein the subject has a liver disease or is at risk of developing a liver disease, the method comprising the steps of:
    determining whether the subject has a CIDEB variant nucleic acid molecule by:
        obtaining or having obtained a biological sample from the subject; and
        performing or having performed a sequence analysis on the biological sample to determine if the subject has a genotype comprising the CIDEB variant nucleic acid molecule, wherein the CIDEB variant nucleic acid molecule is a missense variant, a splice-site variant, a stop-gain variant, a start-loss variant, a stop-loss variant, a frameshift variant, or an in-frame indel variant, or a variant that encodes a truncated CIDEB polypeptide; and
    administering or continuing to administer the CIDEB inhibitor in a standard dosage amount to a CIDEB reference subject; and
    administering or continuing to administer the CIDEB inhibitor in a dosage amount that is the same as or less than a standard dosage amount to a subject that is heterozygous for the CIDEB variant nucleic acid molecule;
    wherein the presence of a genotype having the CIDEB variant nucleic acid molecule indicates the subject has a decreased risk of developing the liver disease or has a decreased risk of developing a more severe form of the liver disease.

2. The method of claim 1, wherein the subject is CIDEB reference, and the subject is administered or continued to be administered the CIDEB inhibitor in a standard dosage amount.

3. The method of claim 1, wherein the subject is heterozygous for the CIDEB variant nucleic acid molecule, and the subject is administered or continued to be administered the CIDEB inhibitor in a dosage amount that is the same as or less than a standard dosage amount.

4. The method of claim 1, wherein the CIDEB variant nucleic acid molecule is a genomic nucleic acid molecule.

5. The method of claim 1, wherein the CIDEB variant nucleic acid molecule is an mRNA molecule.

6. The method of claim 1, wherein the CIDEB variant nucleic acid molecule is a cDNA molecule produced from an mRNA molecule.

7. The method of claim 1, wherein the CIDEB variant nucleic acid molecule comprises 14:24305635:A:AGTAG, 14:24305641:A:C, 14:24305650:G:A, 14:24305657:C:A, 14:24305662:G:T, 14:24305667:T:C, 14:24305671:C:A, 14:24305671:C:G, 14:24305701:A:T, 14:24305709:C:T, 14:24305718:A:G, 14:24305721:T:C, 14:24305728:G: GGCCTT, 14:24305743:T:C, 14:24305948:T:C, 14:24305966:C:T, 14:24305974:T:C, 14:24305980:TCA:T, 14:24305988:C:T, 14:24306014:C:T, 14:24306034:A:C, 14:24306041:C:G, 14:24306044:G:A, 14:24306047:G:A, 14:24306051:T:G, 14:24306064:T:C, 14:24306074:A:G, 14:24306077:G:C, 14:24306082:A:G, 14:24306083:T:A, 14:24306095:G:A, 14:24306122:A:G, 14:24306134:C:G, 14:24306373:C:G, 14:24306379:T:C, 14:24306382:G:A, 14:24306383:G:T, 14:24306426:T:G, 14:24306437:C:G, 14:24306439:G:C, 14:24306442:A:G, 14:24306444:A:G, 14:24306457:C:T, 14:24306463:C:T, 14:24306469:C:T, 14:24306480:A:G, 14:24306486:A:C, 14:24306504:A:G, 14:24306519:A:G, 14:24307382:G:C, 14:24307405:A:G, 14:24307417:A:T, 14:24307421:T:A, 14:24307441:C:A, 14:24307444:A:C, 14:24307444:A:G, 14:24307450:C: CGCTG, 14:24307461:TG:T, 14:24307469:AG:A, 14:24307474:C:T, 14:24307475:A:G, 14:24307833:G:C, 14:24307851:T:TAC, 14:24306426:T:C, 14:24307849:G:C, 14:24307448:G:T, 14:24305671:C:T, 14:24305663:C:T, 14:24305686:C:G, 14:24307829:A:C, 14:24307818:CT-GAG:C, 14:24307856:C:T, 14:24306423:T:C, 14:24306061:AC:A, 14:24307390:C:T, 14:24306382:G:T, 14:24306373:C:T, 14:24305733:T:C, 14:24307858:T:C, 14:24306387:C:T, 14:24305637:T:C, 14:24306062:C:T, 14:24307853:C:G, 14:24307450:C:G, 14:24306052:TG:T, 14:24305673:G:A, 14:24306043:C:T, 14:24307834:G:A, 14:24306417:C:T, 14:24307451:G:A, 14:24307436:A:C, 14:24305953:ACTTT:A, 14:24306489:G:T, 14:24307441:C:T, 14:24306375:C:T, 14:24305657:C:G, 14:24306427:C:T, 14:24306524:C:T, 14:24307516:C:A, 14:24307840:G:C, 14:24307501:A:G, 14:24305968:A:C, 14:24305986:C:T, 14:24307441:C:G, 14:24307459:G:T, 14:24306017:T:A, 14:24307424:G:A, 14:24306072:G:T, 14:24307423:C:T, 14:24307450:C:T, 14:24306420:G:A, 14:24307454:G:A, 14:24305653:C:T, 14:24307442:G:A, 14:24306002:C:T, 14:24306076:C:T, 14:24305664:C:T, 14:24305961:TG:T, 14:24305706:A:G, 14:24305946:C:T, 14:24306455:G:C, 14:24307468:G:A, 14:24307825:A:C, 14:24306110:G:A, 14:24305710:C:T, 14:24307483:C:T, 14:24306459:A:G, 14:24305754:C:T, 14:24305650:G:C, 14:24305691:C:T, 14:24306508:G:C, 14:24306039:G:T, 14:24306139:T:C, 14:24306391:T:C, 14:24306373:C:A, 14:24307498:C:T, 14:24307415:G:A, 14:24306138:CTG:C, 14:24307453:T:C, 14:24305692:G:A, 14:24305683:C:G, 14:24307484:G:A, 14:24307385:C:T, 14:24306519:A:T, 14:24307839:A:C, 14:24305965:C:T, 14:24305988:CAT:C, 14:24306087:C:G, 14:24307439:C:T, 14:24307477:A:C, 14:24306436:G:T, 14:24306507:A:G, 14:24307397:C:T, 14:24307495:G:A, 14:24306034:A:T, 14:24306013:G:A, 14:24307381:A:G, 14:24306383:G:C, 14:24305638:A:G, 14:24307420:G:A, 14:24306020:C:T, 14:24306470:A:C, 14:24307435:C:T, 14:24306469:C:G, 14:24306451:C:T, 14:24306403:G:A, 14:24307515:C:G, 14:24307489:A:G, 14:24307414:C:T, 14:24306483:A:G, 14:24305755:G:A, 14:24305766:C:T, 14:24306064:T:G, 14:24307516:C:G, 14:24305766:C:G, 14:24306489:G:A, 14:24306097:T:C, 14:24305763:T:G, 14:24307447:G:A, 14:24307402:G:A, 14:24305972:C:G, 14:24306423:T:G, 14:24305974:T:TG, 14:24307411:T:C, 14:24306121:T:C, 14:24307516:C:T, 14:24306424:C:T, 14:24306039:G:C, 14:24307853:C:A, 14:24306388:A:G, 14:24305990:T:C, 14:24307822:G:GT, 14:24305640:G:A, 14:24307418:T:C, 14:24305758:G:C, 14:24306131:C:T, 14:24305953:A:G, 14:24305730:C:A, 14:24306418:A:G, 14:24306059:AC:A, 14:24307842:G:A, 14:24307837:T:G, 14:24306095:G:T, 14:24306109:C:T, 14:24307822:G:A, 14:24306077:G:A, 14:24307824:A:T, 14:24306080:C:T, 14:24305649:C:T, 14:24306433:G:GA, 14:24306420:G:C, 14:24305658:T:G, 14:24306472:C:T, 14:24307412:TC:T, 14:24306062:C:A, 14:24306044:G:C, 14:24306047:G:T, 14:24306126:CAG:C, 14:24306449:C:G, 14:24307391:G:A, or 14:24307857:A:C, according to GRCh38/hg38 human genome assembly coordinates.

8. The method of claim 1, wherein the sequence analysis comprises sequencing at least a portion of the nucleotide sequence of the CIDEB genomic nucleic acid molecule, CIDEB mRNA molecule, or CIDEB cDNA molecule produced from an mRNA molecule in the biological sample.

9. The method of claim 8, wherein the sequence analysis comprises:
   a) contacting the biological sample with a primer hybridizing to a portion of the nucleotide sequence of the CIDEB nucleic acid molecule that is proximate to a CIDEB variant nucleic acid molecule position;
   b) extending the primer at least through the CIDEB variant nucleic acid molecule position; and
   c) determining whether the extension product of the primer comprises a variant nucleotide at the CIDEB variant nucleic acid molecule position.

10. The method of claim 8, wherein the sequence analysis comprises sequencing the entire nucleic acid molecule in the biological sample.

11. The method of claim 1, wherein the sequence analysis comprises:
   a) amplifying at least a portion of the CIDEB nucleic acid molecule in the biological sample, wherein the portion comprises a CIDEB variant nucleic acid molecule position;
   b) labeling the amplified nucleic acid molecule with a detectable label;
   c) contacting the labeled nucleic acid molecule with a support comprising an alteration-specific probe, wherein the alteration-specific probe comprises a nucleotide sequence which hybridizes under stringent conditions to the CIDEB variant nucleic acid molecule position; and
   d) detecting the detectable label.

12. The method of claim 1, wherein the sequence analysis comprises:
   contacting the CIDEB nucleic acid molecule in the biological sample with an alteration-specific probe comprising a detectable label, wherein the alteration-specific probe comprises a nucleotide sequence which hybridizes under stringent conditions to a CIDEB variant nucleic acid molecule position; and
   detecting the detectable label.

13. The method of claim 1, further comprising determining the subject's gene burden of having a CIDEB variant nucleic acid molecule.

14. The method of claim 1, further comprising administering a patatin-like phospholipase domain containing 3 (PNPLA3) inhibitor.

15. The method of claim 1, further comprising administering a hydroxysteroid 17-beta dehydrogenase 13 (HSD17B13) inhibitor.

16. The method of claim 14, further comprising detecting the presence or absence of a PNPLA3 variant nucleic acid molecule encoding PNPLA3 Ile148Met or Ile144Met polypeptide in a biological sample from the subject.

17. The method of claim 14, wherein the subject has a PNPLA3 variant nucleic acid molecule encoding PNPLA3 Ile148Met or Ile144Met polypeptide, and the subject is administered a PNPLA3 inhibitor.

18. The method of claim 14, wherein the PNPLA3 inhibitor is AZD2693.

19. The method of claim 15, further comprising detecting the presence or absence of a nucleic acid molecule encoding a reference HSD17B13 polypeptide or a functional HSD17B13 polypeptide and/or a reference HSD17B13 polypeptide or a functional HSD17B13 polypeptide in a biological sample from the subject.

20. The method of claim 15, wherein the HSD17B13 inhibitor is ARO-HSD or ALN-HSD.

21. The method of claim 1, further comprising administering a therapeutic agent for treating a liver disease to the subject.

22. The method of claim 21, wherein the therapeutic agent for treating a liver disease comprises semaglutide.

23. The method of claim 1, wherein the liver disease is fatty liver disease.

24. The method of claim 1, wherein the liver disease is non-alcoholic fatty liver disease (NAFLD).

25. The method of claim 1, wherein the liver disease is non-alcoholic steatohepatitis (NASH).

26. The method of claim 1, wherein the liver disease is liver cirrhosis.

27. The method of claim 1, wherein the liver disease is liver fibrosis.

* * * * *